(12) United States Patent
Hadwiger et al.

(10) Patent No.: US 9,198,947 B2
(45) Date of Patent: Dec. 1, 2015

(54) SMALL MOLECULE CONJUGATES FOR INTRACELLULAR DELIVERY OF NUCLEIC ACIDS

(71) Applicant: Hoffmann-La Roche Inc., Nutley, NJ (US)

(72) Inventors: Philipp Hadwiger, Kulmbach (DE); Torsten Hoffmann, Weil am Rhein (DE); Kerstin Jahn-Hofmann, Neu-Isenburg (DE); Eric A. Kitas, Aesch (CH); David L. Lewis, Madison, WI (US); Peter Mohr, Basel (CH); Hans Martin Mueller, Weilheim (DE); Guenther Ott, Bayreuth (DE); Ingo Roehl, Memmelsdorf (DE); David B. Rozema, Middleton, WI (US)

(73) Assignee: HOFFMANN-LA ROCHE INC., Little Falls, NJ (US)

( * ) Notice: Subject to any disclaimer, the term of this patent is extended or adjusted under 35 U.S.C. 154(b) by 29 days.

(21) Appl. No.: 13/917,493

(22) Filed: Jun. 13, 2013

(65) Prior Publication Data
US 2014/0135380 A1 May 15, 2014

Related U.S. Application Data

(63) Continuation of application No. PCT/EP2011/063436, filed on Aug. 4, 2011.

(60) Provisional application No. 61/427,845, filed on Dec. 29, 2010.

(51) Int. Cl.

| | |
|---|---|
| *C12N 15/87* | (2006.01) |
| *C12N 15/113* | (2010.01) |
| *A61K 38/00* | (2006.01) |
| *C07C 69/96* | (2006.01) |
| *C07C 271/20* | (2006.01) |
| *A61K 31/7088* | (2006.01) |
| *A61K 47/48* | (2006.01) |
| *A61K 48/00* | (2006.01) |
| *C07K 7/02* | (2006.01) |

(52) U.S. Cl.
CPC ............ *A61K 38/00* (2013.01); *A61K 31/7088* (2013.01); *A61K 47/4803* (2013.01); *A61K 47/48061* (2013.01); *A61K 47/48215* (2013.01); *A61K 47/48338* (2013.01); *C07C 69/96* (2013.01); *C07C 271/20* (2013.01); *C12N 15/113* (2013.01); *C12N 15/87* (2013.01); *A61K 48/00* (2013.01); *C07K 7/02* (2013.01); *C07K 2317/77* (2013.01)

(58) Field of Classification Search
USPC ............. 435/9, 1.31, 91.52, 270, 6.11, 91.1, 435/91.31, 6.1, 458; 506/2; 536/23.1, 24.1, 536/24.3, 25.3, 24.31, 25.41, 24.5; 514/44; 525/54.2
See application file for complete search history.

(56) References Cited

U.S. PATENT DOCUMENTS

| | | |
|---|---|---|
| 5,948,902 A | 9/1999 | Honkanen et al. |
| 7,816,337 B2 | 10/2010 | Rozema et al. |
| 8,313,772 B2 | 11/2012 | Rozema et al. |

FOREIGN PATENT DOCUMENTS

| | | |
|---|---|---|
| WO | 01/60415 A1 | 8/2001 |
| WO | 2007/048244 A2 | 5/2007 |
| WO | 2007/138324 A2 | 12/2007 |
| WO | 2008/022309 A2 | 2/2008 |
| WO | WO 2010/148013 | * 12/2010 |
| WO | 2011/154331 A1 | 12/2011 |
| WO | 2012/089352 A1 | 7/2012 |

OTHER PUBLICATIONS

Chen et al. "Lipophilic siRNAs mediate efficient gene silencing in oligodendrocytes with direct CNS delivery" J CONTROLLED RELEASE 144:227-232 (2010).
Doronina et al., "Development of potent monoclonal antibody auristatin conjugates for cancer therapy" NAT BIOTECHNOL 21(7):778-784 (Jul. 2003).
Dubowchik et al. et al., "Cathepsin B-Labile Dipeptide Linkers for Lysosomal Release of Doxorubicin from Internalizing Immunoconjugates: Model Studies of Enzymatic Drug Release and Antigen-Specific In Vitro Anticancer Activity" BIOCONJUGATE CHEM 13:855-869 (2002).
International Search Report and Written Opinion for International Patent Application No. PCT/EP2011/073718.
Jeffrey et al., "Design, synthesis, and in vitro evaluation of dipeptide-based antibody minor groove binder conjugates" J MED CHEM 48: 1344-1358 (2005).
Kularatne et al., "Prostate-specific membrane antigen targeted imaging and therapy of prostate cancer using a PSMA inhibitor as a homing ligand" MOLEC PHARMACEUTICS 6(3):780-789 (2009).
McNamara et al., "Cell type-specific delivery of siRNAs with aptamer-siRNA chimeras" NAT BIOTECHNOL 24(8):1005-1015 (Aug. 2006).
Nishina et al., "Efficient in vivo delivery of siRNA to the liver by conjugation of α-tocopherol" MOLEC THER 16(4):734-740 (Apr. 2008).
Raizada et al., "Polymers in drug delivery: A Review" INTERNATIONAL J PHARMA RES DEV ((Online)), 2(8) (2010).

(Continued)

*Primary Examiner* — Jane Zara
(74) *Attorney, Agent, or Firm* — Alex Andrus; Genentech, Inc.

(57) ABSTRACT

The invention provides use of novel compounds for delivery of nucleic acids, and conjugates of these compounds with nucleic acids. Further novel design criteria for chemically stabilized siRNA particular useful when covalently attached to said compounds and co-administered with a delivery polymer to achieve mRNA knock down in vivo are disclosed therein.

5 Claims, 6 Drawing Sheets

(56) References Cited

OTHER PUBLICATIONS

Rensen et al., "Determination of the upper size limit for uptake and processing of ligands by the asialoglycoprotein receptor on hepatocytes in vitro and in vivo" J BIOL CHEM 276(40):37577-37584 (Oct. 5, 2001).

Rozema et al., "Dynamic polyconjugates for targeted in vivo delivery of siRNA to hepatocytes" P NATL ACAD SCI USA 104(32):12982-12987 (Aug. 7, 2007).

Thomas et al., "Ligand-targeted delivery of small interfering RNAs to malignant cells and tissues" ANN NY ACAD SCI 1175:32-39 (2009).

* cited by examiner

SMALL MOLECULE CONJUGATES FOR INTRACELLULAR DELIVERY OF NUCLEIC ACIDS

CROSS-REFERENCE TO RELATED PATENT APPLICATIONS

This application is a continuation of International Patent Application No. PCT/EP2011/063436, filed Aug. 4, 2011, which claims priority benefit to U.S. Provisional Patent Application No. 61/427,845 filed Dec. 29, 2010, the content of each of which is hereby incorporated herein by reference in its entirety.

SEQUENCE LISTING

The instant application contains a Sequence Listing submitted via EFS-Web and hereby incorporated by reference in its entirety. Said ASCII copy, created on Aug. 26, 2013, is named P5646C1 SL.txt, and is 449,820 bytes in size.

FIELD OF THE INVENTION

The present invention relates to use of novel small molecule conjugates for the delivery of nucleid acids, such as siRNA. The delivery of nucleic acids into a living cell is highly restricted by the complex membrane system of the cell.

BACKGROUND OF THE INVENTION

One means that has been used to deliver nucleic acids in vivo has been to attach the nucleic acid to either a small targeting molecule or a hydrophobic molecule such as a lipid or sterol. While some delivery and activity has been observed with these conjugates when administered to rodents, the dose required has been prohibitively large, resulting often in undesired toxicity effects in vivo and in high costs and impracticable treatment regimen when translated to humans. Provided herein is the use of small molecule compounds for the delivery of nucleid acids, such as siRNA. When the small molecule compounds are conjugated to the nucleic acid, they mediate successful delivery of the nucleic acid into a cell. Surprisingly it has been found that significantly decreased doses of the nucleic acid are now sufficient for successful delivery when using the novel compounds provided herein.

Thus, the use of the compounds provides a powerful tool for the delivery of nucleic acids with considerably limited toxicity in vivo.

BRIEF SUMMARY OF THE INVENTION

In one embodiment, the present invention is directed to the use of compounds of formula (I)

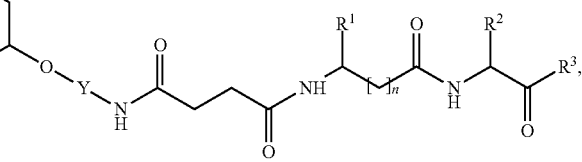

for the delivery of nucleic acids, wherein
Y is a linker group selected from —$(CH_2)_3$— or —C(O)—N—$(CH_2$—$CH_2$—O$)_p$—$CH_2$—$CH_2$—;
$R^1$ is —(C1-6) alkyl;
—$(CH_2)$-naphthyl; or
—$(CH_2)_m$-phenyl, which phenyl is unsubstituted or up to four times substituted with a substituent independently selected from
—$NO_2$,
—CN,
Halogen,
—O—$(CH_2)$-phenyl,
—O—(C1-6) alkyl, or
—C(O)—$NH_2$;
$R^1$ is —(C1-6) alkyl;
$R^2$ is hydrogen;
—$(CH_2)_k$—N—C(Ph)$_3$, which phenyl rings are unsubstituted or independently substituted with —O—(C1-4) alkyl;
—$(CH_2)_k$—C(O)—$NH_2$;
—$(CH_2)_k$-phenyl;
—(C1-6) alkyl, which is unsubstituted or once substituted with —S—$CH_3$;
$R^3$ is —NH-phenyl, which phenyl group is further substituted with a substituent independently selected from
—$(CH_2)$—OH; or
—$(CH_2)$—O—C(O)—O-(4-nitro-phenyl);
k is 1, 2, 3, 4, 5, 6;
m is 1, 2, 3 or 4;
n is 0 or 1; and
p is an integer from 1 to 20.

DETAILED DESCRIPTION OF THE INVENTION

In another embodiment, use of the compounds of formula (I) with the specific conformation as shown in formula (Ia)

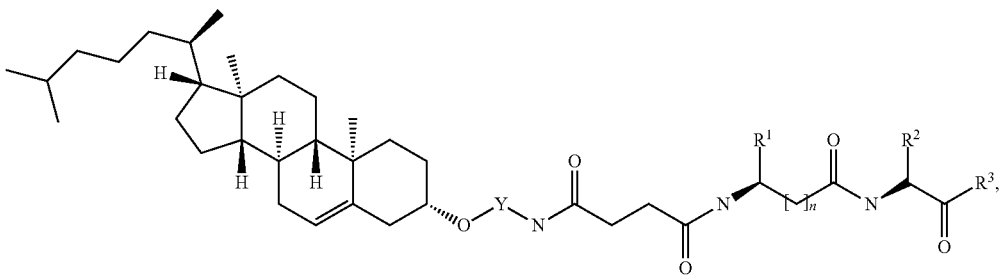

(Ia)

for the delivery of nucleic acids is provided, wherein all substituents $R^1$, $R^2$, $R^3$ and Y as well as the variables k, m, n, and p have the meaning given above.

In yet another embodiment, the present invention is directed to the use of compounds of formula (I) or (Ia) for the delivery of nucleic acids, wherein Y is —(CH2)$_3$—; and all remaining substituent groups have the meaning given above.

In yet another embodiment, the present invention is directed to the use of compounds of formula (I) or (Ia) for the delivery of nucleic acids, wherein Y is —C(O)—N—(CH2-CH2-O)$_p$—CH2-CH2-; and all substituent groups have the meaning given above.

In yet another embodiment, use of the compounds of formulae (I) or (Ia) the delivery of nucleic acids is provided, wherein
Y is —(CH$_2$)$_3$—;
$R^2$ is —(CH$_2$)$_k$—N—C(Ph)$_3$, which phenyl rings are unsubstituted or independently substituted with —O—(C1-4)alkyl; and
$R^3$ is —NH-phenyl, which phenyl group is further substituted with —(CH$_2$)—O—C(O)—O-(4-nitro-phenyl);
n is 0; and
$R^1$ and k have the meanings given above.

In yet another embodiment, there is provided the use of compounds of formulae (I) or (Ia) for the delivery of nucleic acids, wherein
Y is —C(O)—N—(CH$_2$—CH$_2$—O)$_p$—CH$_2$—CH$_2$—;
$R^2$ is —(CH$_2$)$_k$—N—C(Ph)$_3$, which phenyl rings are unsubstituted or independently substituted with —O—(C1-4)alkyl; and
$R^3$ is —NH-phenyl, which phenyl group is further substituted with —(CH$_2$)—O—C(O)—O-(4-nitro-phenyl);
n is 0; and
$R^1$, k and p have the meanings given above The term "(C1-6) alkyl" as used herein means a linear or branched, saturated hydrocarbon containing from 1 to 6 carbon atoms. Preferred C1-6 alkyl groups include methyl, ethyl, propyl, iso-propyl, butyl, 2-butyl and the like.

The term "halogen" as used herein means fluorine, chlorine, bromine, or iodine with fluorine and chlorine being preferred.

The compounds for use in delivery of nucleic acids according to the present invention can be generally obtained using methods known to the person of ordinary skill in the art of organic- or medicinal chemistry. Likewise, it is understood that the cholesterol moiety can be replaced by other natural or chemically synthesized compounds of the steroid class (e.g. cholanic acid, lithocholic acid etc) or other small molecules (e.g. vitamins) known to be effective in nucleic acid delivery such as tocopherol (Molecular Therapy, 2008, 16, 734).

For successful delivery of the nucleic acids, the compounds of formula (I) or (Ia) are covalently attached to the nucleic acids. Preferably, the covalent bond is created by the reaction of a suitable functional group, such as i.e. a primary amine group, in the nucleic acid with the activated carbonyl group in the —O—C(O)—O— moiety of $R^3$ as defined herein before. Hence provided herein is a conjugate comprising the compounds of formula (I) or (Ia) and a nucleic acid.

The term "nucleic acid" as used herein refers to any form of DNA, including cDNA, or RNA, or a fragment thereof, nucleotide, nucleoside, oligonucleotides (including antisense oligonucleotides, LNA and siRNA), that causes a biological effect when administered in vivo to an animal, including but not limited to birds and mammals, including humans. Preferred nucleic acids used herein are siRNAs.

The conjugate comprising the compounds covalently attached to a nucleic acid shows an improved ability to be taken up by cells compared to said nucleic acid alone. Once the conjugate is delivered into the cell and trafficking to the lysosome, the corresponding nucleic acid is released by enzymatic cleavage. This cleavage preferably takes place when a di-peptide motif, preferably consisting of the sequence α- or β-(phenyl)alanine and lysine as present in the compounds of formula (I) or (Ia) is incorporated in the conjugate (see scheme 1). Most preferably the conjugate contains the di-peptide motif and a spacer such as the p-aminobenzylcarbamate spacer (Bioconjugate Chem. 2002, 13, 855) that spontaneously fragments once the amide bond C-terminal of the di-peptide motif is cleaved as exemplified for siRNAs in scheme 2. Hence the conjugates comprising compounds of formula (I) or (Ia) are also referred to as dipeptide containing cholesterol conjugates. Enzymatic cleavage of the nucleic acid from the dipeptide containing cholesterol conjugates of this invention is catalyzed by innate proteases of the cell. One example of an innate protease capable of cleaving the di-peptide motif present in the compounds of formula (I) or (Ia) is Cathepsin B. Cathepsin B is a known ubiquitous cysteine protease located in the lysosomes of mammalian cells (Bioconjugate Chem. 2002, 13, 855; J. Med. Chem. 2005, 48, 1344; Nat. Biotechnology 2003, 21, 778). Thus, the di-peptide motif described above is also referred to as Cathepsin-cleavable dipeptide-motif.

The present invention therefore also provides a method for delivery of a nucleic acid, into cells wherein said nucleic acid may subsequently be cleaved off the conjugate to unfold a therapeutic activity.

In a further embodiment of the present invention, there is provided the use of a conjugate of the compounds of formula (I) or (Ia) covalently attached to a siRNA for intracellular delivery.

Conjugates of formula (I) or (Ia) covalently attached to a nucleic acid are designated herein as formula (II) or (IIa), respectively.

Scheme 1

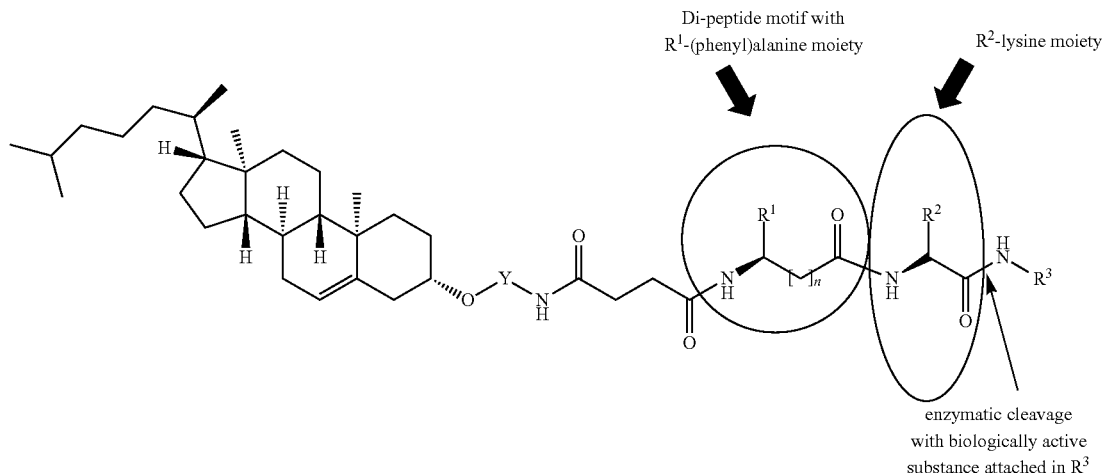

Therefore, in a further embodiment, the present invention provides a compound of formula

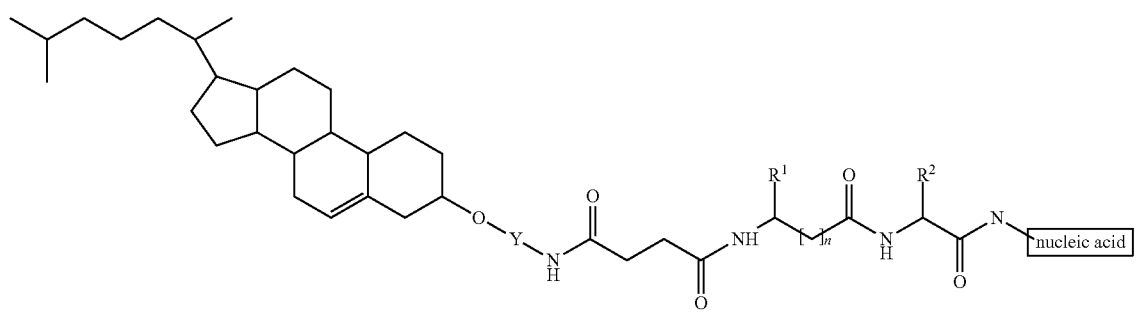

wherein
$R^a$ is —$(CH_2)_k$—$NH_2$;
$R^1$ and k have the meanings given for formula (I) above.
In a more specific embodiment, the present invention provides compounds of formula

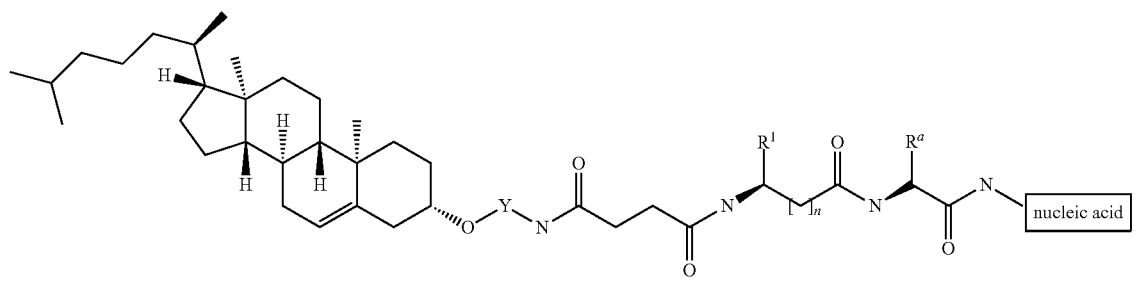

wherein
$R^a$ is —$(CH_2)_k$—$NH_2$;
$R^1$ and k have the meanings given for formula (I) above.

In a preferred embodiment, the nucleic acid in formula (II) or (IIa) is a siRNA.

The compounds of formula (II) or (IIa) may have valuable properties in therapy. Therefore, in a further embodiment, there are provided the compounds of formula (II) or (IIa) for use as medicaments.

Another embodiment of the invention is a pharmaceutical composition comprising the conjugates of the compounds of formula (I) or (Ia) covalently attached to a nucleic acid.

In still another embodiment of the invention there is provided a pharmaceutical composition comprising the compounds of formula (IIa) together with pharmaceutically acceptable excipients.

Below embodiments are exemplified for conjugates of the compounds of formula (I) or (Ia) covalently attached to siRNA. It is understood that these embodiments are also applicable for other types of nucleic acids as defined above.

The covalent attachment of the siRNA to the compounds of formula (I) or (Ia) is achieved via reaction of a suitable nucleophilic group, i.e. a primary amine group, in the siRNA with the activated —C(O)— group in R3 of said compounds of formula (I) or (Ia). The activation of that —C(O)— group is obtained by a p-nitrophenoxy carbonate as shown in scheme 2 below.

reaction as also shown in scheme 3. The cholesterol moiety of the conjugate of the compounds of formula (II) or (IIa) modifies the PK properties of siRNA in such a way that systemic administration enables gene silencing in vivo.

In one embodiment the compounds of formula (II) or (IIa) wherein the nucleic acid is siRNA is co-administered with a delivery polymer. Delivery polymers provide a means of disrupting cell membranes and mediate endosomal release. In another embodiment, said delivery polymer and the siRNA conjugate of the invention are not covalently attached and synthesized separately and may be supplied in separate containers or a single container. Delivery polymers for oligonucleotides such as siRNA are well known in the art.

For example, Rozema et al., in U.S. Patent Publication 20040162260 demonstrated a means to reversibly regulate (scheme 2)

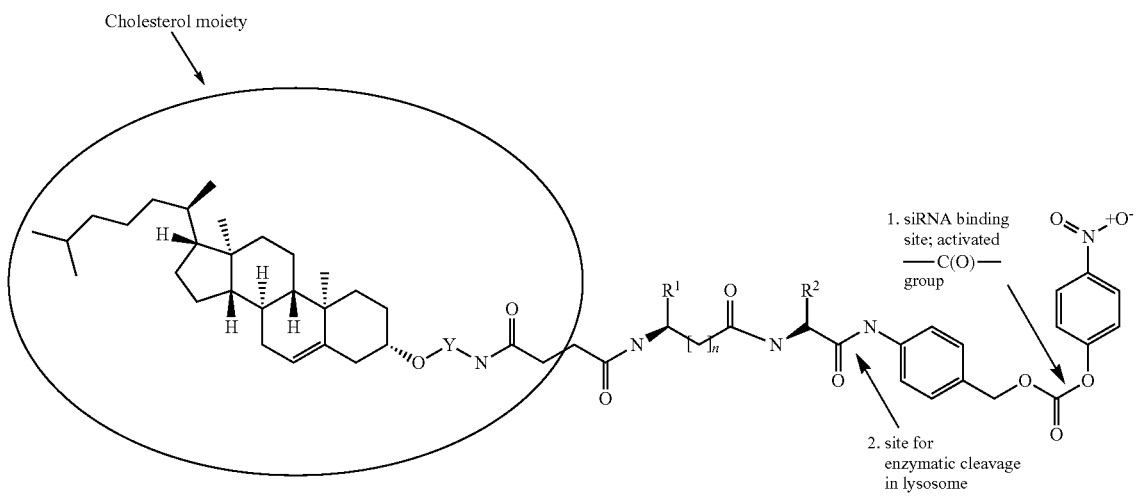

The p-nitrophenyl activated carbonate may for example be reacted with the siRNA equipped with a suitable nucleophile such as the primary amine of a hexylamino-linker to generate a carbamate linkage to yield the covalent siRNA conjugate. Once the siRNA is taken up intracellularly and transferred to the lysosome the compounds of formula (II) or (IIa) wherein the biological active substance is a siRNA are cleaved by the protease activity releasing the siRNA via a 1,6-elimination membrane disruptive activity of a membrane active polyamine. Reversible regulation provided a means to limit activity to the endosomes of target cells, thus limiting toxicity. Their method relied on reaction of amines on the polyamine with 2-propionic-3-methylmaleic anhydride. This modification converted the polycation to a polyanion via conversion of primary amines to carboxyl-containing groups and reversibly inhibited membrane activity of the polyamine.

Scheme 3

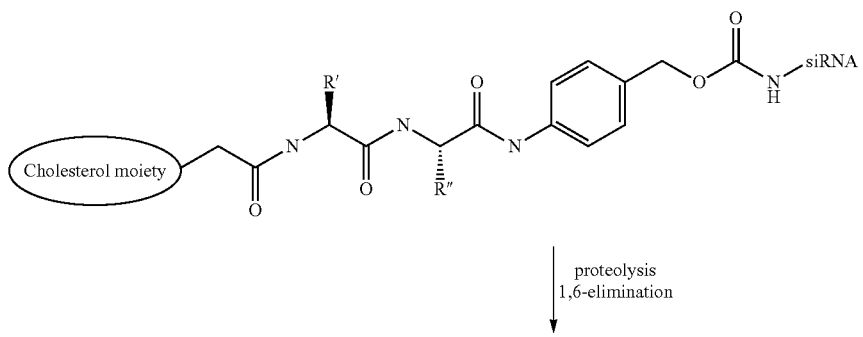

proteolysis
1,6-elimination

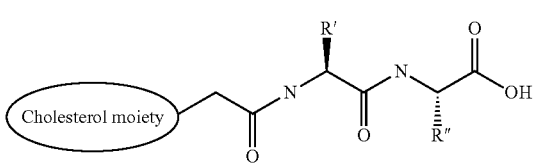 + 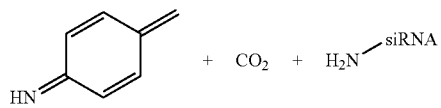 + $CO_2$ + $H_2N$–siRNA

To enable co-delivery of the nucleic acid with the delivery vehicle, the nucleic acid was covalently linked to the delivery polymer. In U.S. provisional patent application 61/307,490 a new generation of delivery polymers is described. Therein, membrane active polyamine comprising an amphipathic terpolymer formed by random polymerization of amine-containing monomers, lower hydrophobic monomers, and higher hydrophobic monomers are provided. This new generation of delivery polymers removed the requirement that polynucleotide and polymer are associated either by covalent linkage or by charge-charge interaction.

Non-limiting examples of delivery polymers used for co-administration with the siRNA conjugates of the present invention are membrane active polyamines and poly(vinyl ether) (PBAVE), Dynamic PolyConjugates (DPC; Rozema et al. 2007) and improved DPCs as disclosed in U.S. provisional patent application 61/307,490.

In a further embodiment, a new chemical siRNA modification pattern for functional in vivo delivery is provided. This new chemical siRNA modification pattern is especially useful with delivery vehicles which display a relatively strong endosomal/lysosomal retention.

It was found that siRNA stabilization against degradation by endosomal/lysosomal-localized nucleases such as DNAse II strongly improves target knock down. Such stabilization may directly effect the amount of siRNA released into the cytoplasm where the cellular RNAi machinery is located. Only the siRNA portion available in the cytoplasm is able to trigger the RNAi effect.

In addition to poor pharmacokinetic characteristics, siRNAs are susceptible to nucleases in the biological environment when administered as such into the circulation without a protecting delivery vehicle. Accordingly, many siRNAs are rapidly degraded either extracellularly in the tissue and blood stream or after intracellular uptake (e.g. in the endosome).

One well known nuclease localized in the endosomal/lysosomal compartment is DNase II. This enzyme is active at a pH below 6-6.5 with maximum activity in the pH-range of 4.5-5, reflecting conditions present in the acidified environment of the endosomal/lysosomal compartment. The following RNA degradation pathways induced by DNase II were identified in vitro and are disclosed in this invention:

A. RNA strands containing at least one 2'-OH nucleotide are rapidly degraded via a cyclic pentavalent phosphorus intermediate, leading to 2'-3' cyclic phosphates at the 5'-cleavage product. The formation of the pentavalent intermediate can be inhibited by nucleotides lacking a 2'-OH group such as 2'-deoxy, 2'-O-methyl (2'-OMe) or 2'-deoxy-2'-fluoro (2'-F) nucleotides.

B. Additionally, RNA is degraded in a 5'-exonucleolytic pathway independent of the 2'-modification on the 5'-terminal nucleotides. This degradation pathway can be inhibited by 5'-terminal non-nucleotide moieties, like e.g. cholesterol, aminoalkyl-linker or a phosphorothioate at the first internucleotide linkage.

C. A 5'-phosphate also protects and slows down the exonucleolytic cleavage kinetics, but can not fully block this pathway. This is most probably due to the cleavage of the 5'-phosphate by phosphatases or an inherent phosphatase activity of the DNase II enzyme preparation used in the in vitro stability assay.

D. The best protection was achieved with oligonucleotides lacking any 2'-OH nucleotide within the strand, starting with a 2'-OMe nucleotide at the 5'-end connected by a phosphorothioate (PTO) linkage to the second nucleotide. Other terminal nucleotides lacking a 2'-OH group also protect against the 5'-exo degradation, but to a lower extent compared to the 2'-OMe modification.

Hence the inventors of the present invention found that siRNAs can be significantly stabilized when using the following design, wherein an oligonucleotide is provided with an antisense strand with the modification pattern: 5'-(w)-(Z1)-(Z2)-(Z3)na-3' and a sense strand with the modification pattern 5'-(Z3)$_n$ s-3', wherein w is independently a 5'-phosphate or 5'-phosphothioate or H,
Z1 is independently a 2'-modified nucleoside.
Z2 is independently a 2'-deoxy nucleoside or 2'-Fluoro-modified nucleoside,
Z3 is independently a 2'-modified nucleoside,
$n_a$ is 8-23 and $n_s$ is 8-25.

In one preferred embodiment an oligonucleotide is provided with an antisense strand with the modification pattern: 5'-(w)-(Z1)-(Z2)-(Z3)na-3' and a sense strand with the modification pattern 5'-(Z3)ns-3', wherein Z1 is a 2'-Fluoro-modified nucleoside or a 2deoxy-nucleoside and all remaining substituents as well as the variables na and ns have the meaning given above.

In one preferred embodiment an oligonucleotide is provided with an antisense strand with the modification pattern: 5'-(w)-(Z1)-(Z2)-(Z3)na-3' and a sense strand with the modification pattern 5'-(Z3)ns-3', wherein Z3 is a 2'-O-Methyl modified nucleoside, a 2'-Fluoro-modified nucleoside or a 2deoxy-nucleoside and all remaining substituents as well as the variables na and ns have the meaning given above.

In one preferred embodiment an oligonucleotide is provided with an antisense strand with the modification pattern: 5'-(w)-(Z1)-(Z2)-(Z3)na-3' and a sense strand with the modification pattern 5'-(Z3)ns-3', wherein Z1 is a 2'-Fluoro-modified nucleoside or a 2' deoxy-nucleoside and Z3 is a 2'-O-Methyl modified nucleoside, a 2'-Fluoro-modified nucleoside or a 2deoxy-nucleoside and all remaining substituents as well as the variables na and ns have the meaning given above.

The nucleosides in the nucleic acid sequence of the oligonucleotide with the novel modification pattern can either be linked by 5'-3' phosphodiesters or 5'-3' phosphorothioates.

As used herein, the "anti-sense" strand is the siRNA strand that is complementary to the target mRNA and that will be binding to the mRNA once the siRNA is unwound.

The sense strand of said siRNA comprising the novel modification pattern is complimentary to the antisense strand.

Said siRNA comprising the novel modification pattern proofed to be particularly advantageous when covalently attached to a delivery polymer as exemplified by Rozema et al. (Dynamic PolyConjugates (DPC; Rozema et al. 2007). Potency and duration of effect can be significantly enhanced employing the siRNA modification strategy outlined in this invention.

In another embodiment, said siRNA comprising the novel modification pattern are especially useful when conjugated to small molecules that alter the pharmacokinetic properties of siRNA such as cholesterol or the compounds of formula (I) and (Ia) provided herein. In one embodiment a conjugate of a small molecule and an oligonucleotide is provided wherein the oligonucleotide has the following modification pattern: the antisense strand with the modification pattern: δ 5'-(w)-(Z1)-(Z2)-(Z3)na-3' and a sense strand with the modification pattern 5'-(Z3)ns-, wherein the substituents as well as the variables na and ns have the meaning given above. In one embodiment said small molecule is cholesterol. In another embodiment said small molecule is a compound of formula (I) or (I a), resulting in compounds of formula (II) or (IIa).

Preferably, said siRNAs conjugates are co-administered with a delivery polymer. Suitable delivery polymers are described above.

In one embodiment, said siRNA comprising the novel modification pattern are especially useful when conjugated to a ligand that is known to bind to a specific receptor which internalizes the conjugate into a cell. Particularly, the asialoglycoprotein receptor (ASGPR) expressed on hepatocytes is a well-known receptor enabling the clearance (endocytosis and lysosomal degradation) of desilylated proteins from circulation. It has been shown that the N-Acetyl-D-galactosamine has a high binding affinity for the receptor, especially when presented multivalent and when the galactose residues are properly spaced (J Biol Chem, 2001, 276, 37577). In order to utilize this high capacity receptor for receptor mediated endocytosis of the nucleic acid, the synthetic ligand shown below was prepared to be covalently attached to the siRNAs comprising the novel modification pattern. Since this type of endocytosis leads to lysosomal degradation of the internalized material the siRNA must be prepared in such a way that it is stable in the lysosome, which is now solved by the novel modification pattern outlined above.

Likewise, it is understood that the targeting ligand shown in formula III conjugated to a nucleic acid such as siRNA as shown in formula IV can be replaced by other natural or chemically synthesized compounds (antagonists or agonists) displaying a high binding affinity to cell surface expressed receptors. Example include folate as ligand for the folate receptor expressed on a variety of cancer cells (Ann. N.Y. Acad. Sci., 2009, 1175, 32) or PSMA binding molecules (Nature Biotech, 2006, 24, 1005; Mol Pharm, 2009, 6, 780).

The ligand for the ASGPR is attached via an amide bond to the nucleic acid. The amide bond formation can be established with the aid of N-Hydroxy-succinimide (NHS) chemistry. The ligand employed in the conjugation reaction is shown below (formula III). For interaction with the ASGPR the O-acetate groups on the sugars residues need to be removed as shown in (formula IV) for siRNA.

(III)
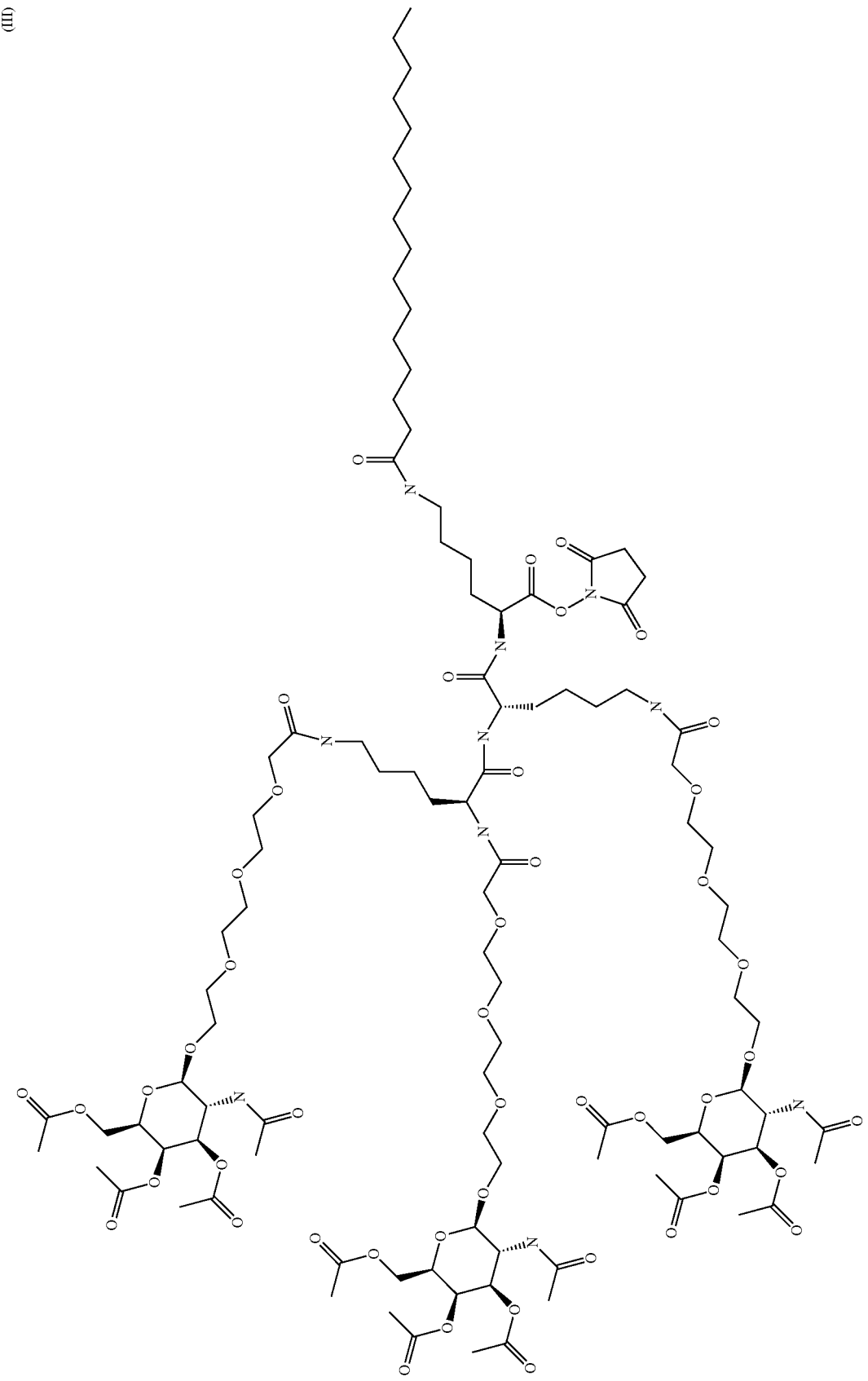

(IV)
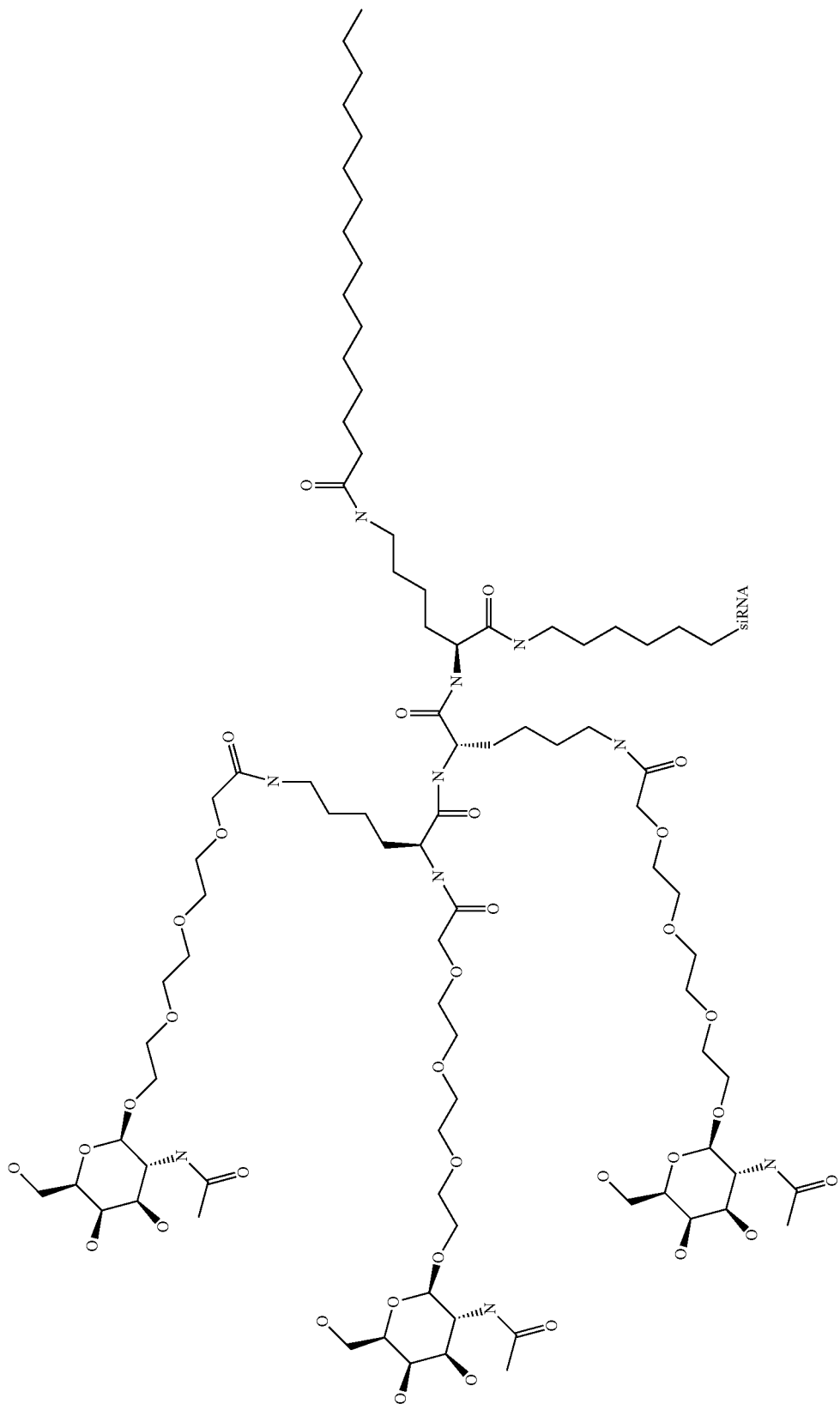

In one embodiment of the invention, a conjugate of a compound of formula IV and an oligonucleotide is provided, wherein the oligonucleotide has the following modification pattern: the antisense strand with the modification pattern 5'-(w)-(Z1)-(Z2)-(Z3)na-3' and a sense strand with the modification pattern 5'-(Z3)ns-, wherein the substituents as well as the variables na and ns have the meaning given above. Said conjugate is also referred to as GalNAc palmitoyl conjugate. Preferably, said GalNAc palmitoyl conjugate are co-administered with a delivery polymer. Suitable delivery polymers are described above.

It was found that for these modification patterns cleavable linkers proofed to be advantageous compared to stably linked small molecule ligands. Possible cleavable linkers are a di-peptide motif as exemplified in scheme 1 or a cleavable RNA-linker comprising 2'-OH containing nucleotides. The cleavable RNA-linker is especially useful in connection with the siRNAs having the novel modification pattern (fully 2'-modified siRNA) described above.

In principle a nuclease cleavage site can be introduced by 3'- or 5'-overhangs containing at least one 2'-OH nucleotide at either the sense or the antisense strand. The final active siRNA species is generated by intracellular nuclease processing. Also, the use of defined cleavage sites implemented by 2'-OH nucleotides within the base paired region is possible. This can be done using at least one 2'-OH nucleotide complementary to the opposite strand or by introduction of either at least one mismatched 2'-OH nucleotide or a hairpin/bulge containing at least one 2'-OH nucleotide.

In contrast to other cleavable linker chemistries the use of defined cleavage sites by introduction of 2'-OH nucleotides lead to a more versatile conjugation approach. By introducing selective cleavage sites on one or on both strands of the siRNA either at the 3' and/or the 5'-end or within the duplex structure, multiple conjugation is possible.

Accordingly, in one embodiment, a conjugate of a small molecule and an oligonucleotide is provided wherein
a) the small molecule comprises a nucleotide linker comprising 1-10 preferably 1-5, most preferably 1-3 2'OH-nucleotides;
b) the oligonucleotide has the following modification pattern: the antisense strand with the modification pattern 5'-(w)-(Z1)-(Z2)-(Z3) n$_a$-3' and a sense strand with the modification pattern 5'-(Z3) n$_s$-, wherein the substituents as well as the variables n$_a$ and n$_s$ have the meaning given above; and
c) the oligonucleotide is covalently attached via the nucleotide linker to the small molecule.

The nucleotide linker is cleaved e.g. in the endosome by intracellular nucleases such as DNAse II after internalization of the conjugate, thus releasing the siRNA.

Preferably, said conjugate is co-administered with a delivery polymer. Suitable delivery polymers are described above.

In another embodiment of the invention a compound of formula (V) is provided. This compound comprises a cholesterol moiety, and a nucleotide linker comprising 1-10 preferably 1-5, most preferably 1-3 2'OH-nucleotides. This nucleotide linker is useful for covalently attaching an oligonucleotide such as a siRNA to the compound of formula (V). Preferably, said oligonucleotide has the novel modification pattern outlined above. Hence in another embodiment a conjugate of a compound of formula (V) and an oligonucleotide is provided, wherein the oligonucleotide is covalently attached to the nucleotide linker of the compound of formula (V).

The nucleotide linker is cleaved by intracellular nucleases such as DNAse II after internalization of the conjugate of a compound of formula (V) and an oligonucleotide into the endosome, thus releasing the siRNA.

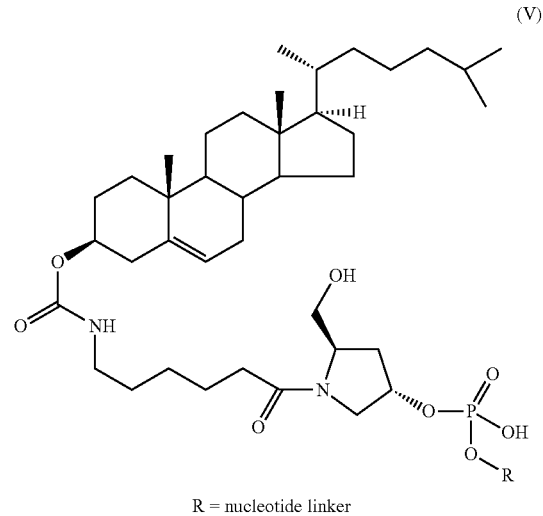

(V)

R = nucleotide linker

Preferably, said conjugate of a compound of formula (V) and an oligonucleotide is co-administered with a delivery polymer. Suitable delivery polymers are described above.

In another embodiment, said delivery polymer and the conjugate of a compound of formula (V) and an oligonucleotide of the invention are not covalently attached and synthesized separately and may be supplied in separate containers or a single container.

DEFINITIONS

The term "small molecule" as used herein, refers to organic or inorganic molecules either synthesized or found in nature, generally having a molecular weight less than 10,000 grams per mole, optionally less than 5,000 grams per mole, and optionally less than 2,000 grams per mole.

The term "peptide" as used herein refers to any polymer compound produced by amide bond formation between an .alpha.-carboxyl group of one D- or L-amino acid and an .alpha.-amino group of another D- or L-amino acid. The term "protein" as used herein refers to polypeptides of specific sequence of more than about 50 residues.

The term "di-peptide motif" as used herein refers to any motif comprising an amide bond formed by either the D- or L-alpha or beta amino group of a first amino acid with the alpha-carboxyl group of a second D- or L-amino acid.

As used herein, the term "amino acid" refers to any molecule that contains both amine and carboxyl functional groups. Thus the term "amino acid" refers to both natural, non-natural and synthetic amino acids. Any natural amino acids used in the present invention are referred to herein by their common abbreviations.

The term "ligand" as used herein refers to a moiety that is capable of covalently or otherwise chemically binding a nucleic acid. The term "ligand" in the context of the invention is preferably a compound of formula (I) or (Ia) covalently attached to a nucleic acid.

The term "nucleic acid" as used herein means an oligomer or polymer composed of nucleotides, e.g., deoxyribonucleotides or ribonucleotides, or compounds produced synthetically (e.g., PNA as described in U.S. Pat. No. 5,948,902 and the references cited therein) which can hybridize with naturally occurring nucleic acids in a sequence specific manner analogous to that of two naturally occurring nucleic acids, e.g., can participate in Watson-Crick base pairing interactions. Non-naturally occurring nucleic acids are oligomers or polymers which contain nucleobase sequences which do not occur in nature, or species which contain functional equivalents of naturally occurring nucleobases, sugars, or inter-sugar linkages, like peptide nucleic acids (PNA), threose nucleic acids (TNA), locked nucleic acids (LNA), or glycerol nucleic acids (GNA). This term includes oligomers that contain the naturally occurring nucleic acid nucleobases adenine (A), guanine (G), thymine (T), cytosine (C) and uracil (U), as well as oligomers that contain base analogs or modified nucleobases. Nucleic acids can derive from a variety of natural sources such as viral, bacterial and eukaryotic DNAs and RNAs. Other nucleic acids can be derived from synthetic sources, and include any of the multiple oligonucleotides that are being manufactured for use as research reagents, diagnostic agents or potential and definite therapeutic agents. The term includes oligomers comprising of a single strand nucleic acid or a double strand nucleic acid.

The term "2'-modified" as used herein refers to a β-D-ribonucleoside or β-D-ribonucleotide comprising of naturally occurring nucleobases having the 2'-OH group replaced by H, F, O—CH3 or other substituents known in the art.

The term "2'-OH-nucleotide" as used herein refers to β-D-ribonucleotide comprising of naturally occurring nucleobases having a 2'-OH group.

The term "5'-phosphate" as used herein refers to the formula —O—P(=O)(OH)OH. In another aspect the phosphate is modified such that one of the O or OH groups is replaced by S and termed herein as "5'-phosphothioate".

The term "phosphorothioate" as used herein refers to an internucleotide linkage in which one of the non-bridging oxygens is replaced by sulfur.

The term "delivery polymer" as used herein refers to polymers suitable for functional delivery of a nucleic acid. In the context of the present invention the delivery polymer is either covalently attached to or coadministered with the biologically substance conjugated to the compounds described herein and mediates endosomal escape after internalization into the cell and uptake into the endosome. The term "polymer" in this context means any compound that is made up of two or more monomeric units covalently bonded to each other, where the monomeric units may be the same or different, such that the polymer may be a homopolymer or a heteropolymer. Representative polymers include peptides, polysaccharides, nucleic acids and the like, where the polymers may be naturally occurring or synthetic. Non-limiting examples of delivery polymers are for example reviewed in INTERNATIONAL JOURNAL OF PHARMACEUTICAL RESEARCH AND DEVELOPMENT, October-2010/Volume-2/Issue-8/Article No-2. Non-limiting examples of delivery polymers useful for delivery of nucleic acids are disclosed in EP applications 10165502.5 and 10191030.5, PCT publication WO 2008/0022309 and U.S. provisional application 61/307,490 and references cited herein; which are all included by reference.

As used herein, "pharmaceutical composition" includes the conjugates of the invention, a pharmaceutical carrier or diluent and any other media or agent necessary for formulation.

As used herein, "pharmaceutical carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g. by injection or infusion).

A conjugate of the present invention can be administered by a variety of methods known in the art. As will be appreciated by the skilled artisan, the route and/or mode of administration will vary depending upon the desired results. To administer a conjugate of the invention by certain routes of administration, it may be necessary to coat the conjugate with, or co-administer the conjugate with, a material to prevent its inactivation. For example, the conjugate may be administered to a subject in an appropriate carrier or a diluent. Pharmaceutically acceptable diluents include saline and aqueous buffer solutions. Pharmaceutical carriers include sterile aqueous solutions or dispersions and sterile powders for the extemporaneous preparation of sterile injectable solutions or dispersion. The use of such media and agents for pharmaceutically active substances is known in the art.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

These carriers may also contain adjuvants such as preservatives, wetting agents, emulsifying agents and dispersing agents. Prevention of presence of microorganisms may be ensured both by sterilization procedures, supra, and by the inclusion of various antibacterial and antifungal agents, for example, paraben, chlorobutanol, phenol, sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

Regardless of the route of administration selected, the conjugates of the present invention, which may be used in a suitable hydrated form, and/or the pharmaceutical compositions of the present invention, are formulated into pharmaceutically acceptable dosage forms by conventional methods known to those of skill in the art.

Actual dosage levels of the active ingredients in the pharmaceutical compositions of the present invention may be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions of the present invention employed, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts.

The pharmaceutical composition must be sterile and fluid to the extent that the composition is deliverable by syringe. In addition to water, the carrier preferably is an isotonic buffered saline solution.

Proper fluidity can be maintained, for example, by use of coating such as lecithin, by maintenance of required particle size in the case of dispersion and by use of surfactants. In many cases, it is preferable to include isotonic agents, for example, sugars, polyalcohols such as mannitol or sorbitol, and sodium chloride in the composition.

SHORT DESCRIPTION OF THE FIGURES

Figure 5:
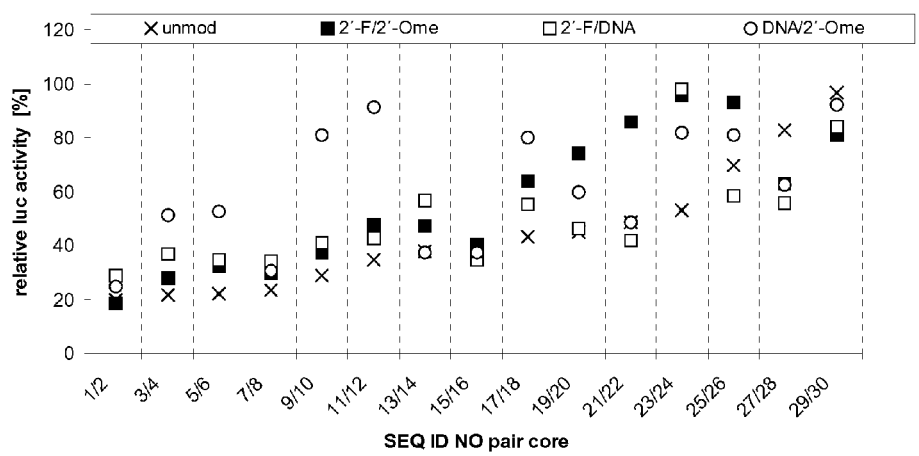
Figure 5:
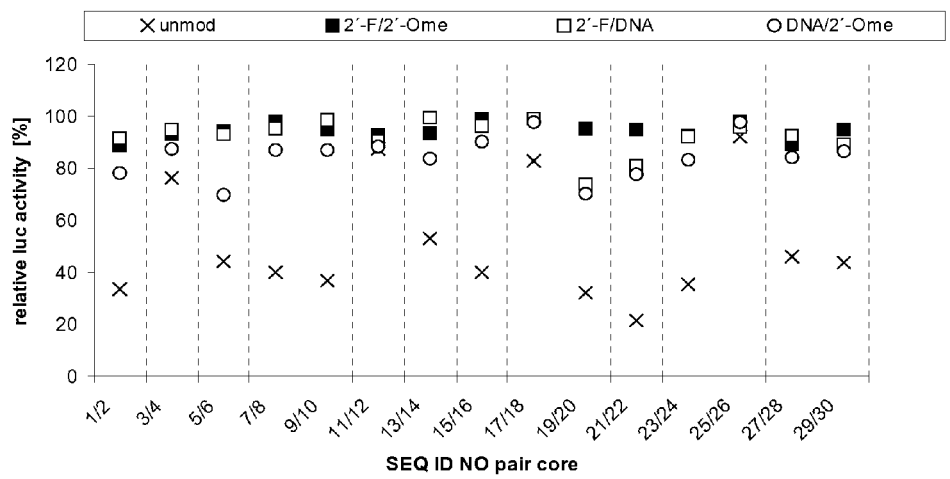

FIG. 5a shows antisense strand mediated gene silencing with fully 2'-modified siRNAs. COS7 cells were cotransfected with EGFP-directed siRNAs at 3 nM and psiCHECK2-AT. The knockdown activity of the siRNAs was assessed by measuring renilla versus firefly luciferase activity from the reporter construct. siRNAs were sorted by knockdown activity of unmodified (2-19-2) reference siRNAs.

FIG. 5b shows sense strand mediated gene silencing with fully 2'-modified siRNAs. COS7 cells were cotransfected with EGFP-directed siRNAs at 3 nM and psiCHECK2-ST. The knockdown activity of the siRNAs was assessed by measuring luciferase expression from the reporter construct. siRNAs were sorted by knockdown activity of unmodified (2-19-2) reference siRNAs.

Figure 6:
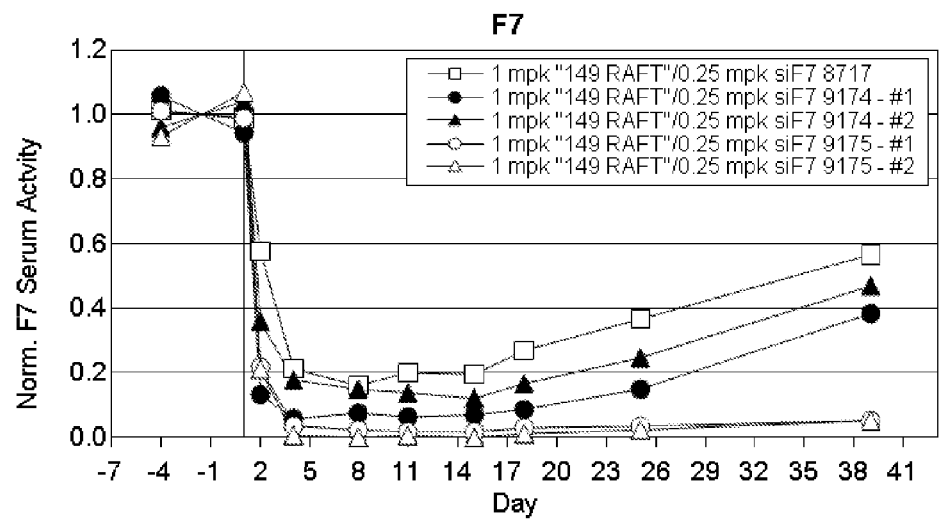
Figure 6:
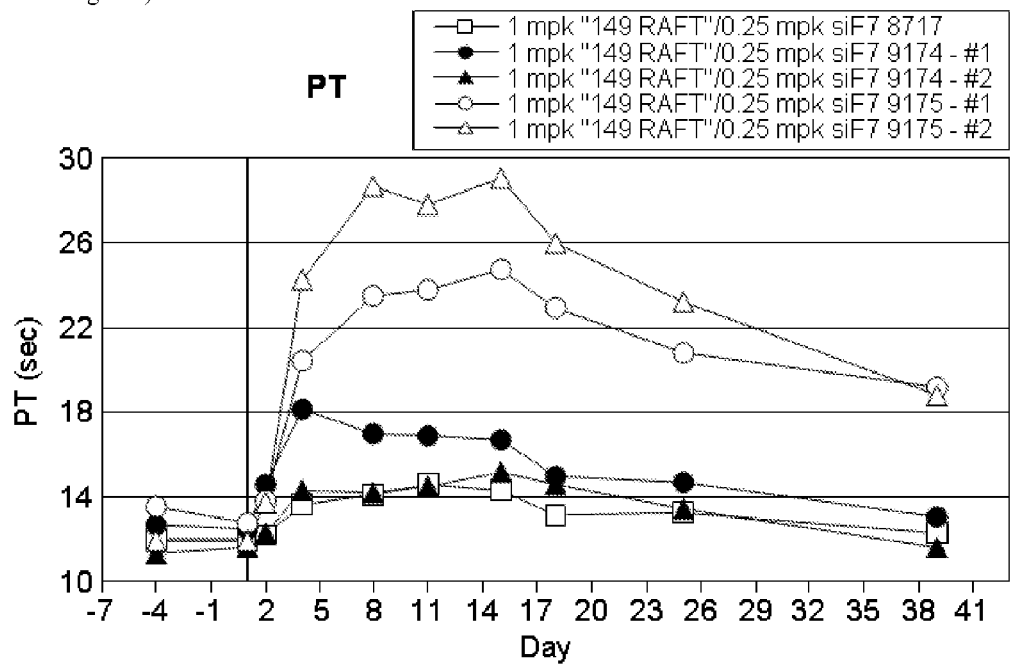

FIG. 6a shows reduction of serum FVII activity in non-human primates upon intravenous injection of various 2'-modified siRNAs covalently attached to a delivery polymer.

FIG. 6b shows the development of the prothrombin time in non-human primates upon treatment with 2'-modified siRNAs covalently conjugated to a delivery polymer.

EXAMPLES

The following examples are meant as references example solely, in order to illustrate the synthesis of the compounds for use in delivery of nucleic acids. They are not intended to form part of the invention.

Example 1

Step 1

3-[(3S,8S,9S,10R,13R,14S,17R)-17-((R)-1,5-Dimethyl-hexyl)-10,13-dimethyl-2,3,4,7,8,9,10,11,12,13,14,15,16,17-tetradecahydro-1H-cyclopenta[a]phenanthren-3-yloxy]-propylamine

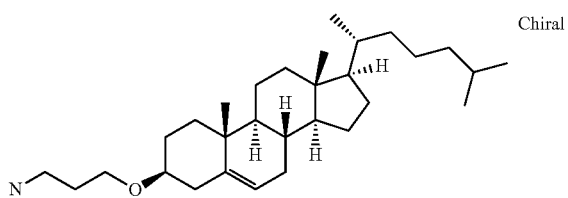

The title amine was prepared from its nitrile precursor according to a literature protocol [Lollo et al, WO2001/070415].

Step 2

N-{3-[(3S,8S,9S,10R,13R,14S,17R)-17-((R)-1,5-Dimethyl-hexyl)-10,13-dimethyl-2,3,4,7,8,9,10,11,12,13,14,15,16,17-tetradecahydro-1H-cyclopenta[a]phenanthren-3-yloxy]-propyl}-succinamic acid

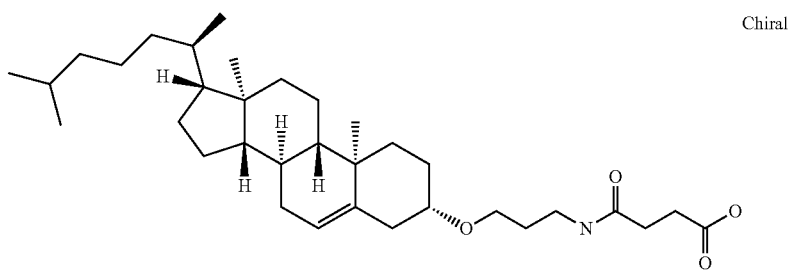

In a 2 L round-bottomed flask, 3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propan-1-amine (21.15 g, 47.7 mmol, Eq: 1.00) and Huenig's base (12.3 g, 16.6 ml, 95.3 mmol, Eq: 2.00) were combined with AcOEt (845 ml) to give a colorless solution. Dihydrofuran-2,5-dione (4.77 g, 47.7 mmol, Eq: 1.00) in THF (42 ml) was added and the reaction mixture was stirred at ambient temperature over night=>white suspension. All volatiles were removed i. v., the residue dissolved in $CH_2Cl_2$, the organic layer washed with $NH_4Cl$ and brine, dried over $Na_2SO_4$, and evaporated to dryness. The crude product was dissolved in $CH_3CN/H_2O$ and lyophilized to yield 29.8 g of the title compound as fluffy powder. MS (ISP): (M−H) 542.5.

Step 3

N1-(3-((3S,8S,9S,10R,13R,14S,17R)-10,13-Dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-((S)-1-(4-(hydroxymethyl)phenylamino)-6-((4-methoxyphenyl)diphenylmethylamino)-1-oxohexan-2-ylamino)-3-(4-nitrophenyl)-1-oxopropan-2-yl)succinamide In a 10 mL round-bottomed flask, the above prepared 4-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propylamino)-4-oxobutanoic acid (106 mg, 184 μmol, Eq: 1.00), (S)-2-(S)-2-amino-3-(4-nitrophenyl)propanamido)-N-(4-(hydroxymethyl)phenyl)-6-((4-methoxyphenyl)diphenylmethylamino)hexanamide (132 mg, 184 μmol, Eq: 1.00), HOAt (25.0 mg, 184 μmol, Eq: 1.00) and EDC hydrochloride (35.3 mg, 184 μmol, Eq: 1.00) were mixed together in $CH_2Cl_2$ (1.8 ml) to give a yellow solution. Huenig's Base (47.5 mg, 64.2 μl, 368 μmol, Eq: 2.00) was added and the reaction stirred at ambient temperature over night. TLC indicated the consumption of starting material. All volatiles were removed i. V. and the crude product purified by flash chromatography $SiO_2$/7% MeOH/0.1% $NEt_3$ in $CH_2Cl_2$ to produce 128 mg of the title compound as light yellow solid. MS: expected mass: 1240.7552, found mass: 1240.7518.

Step 4

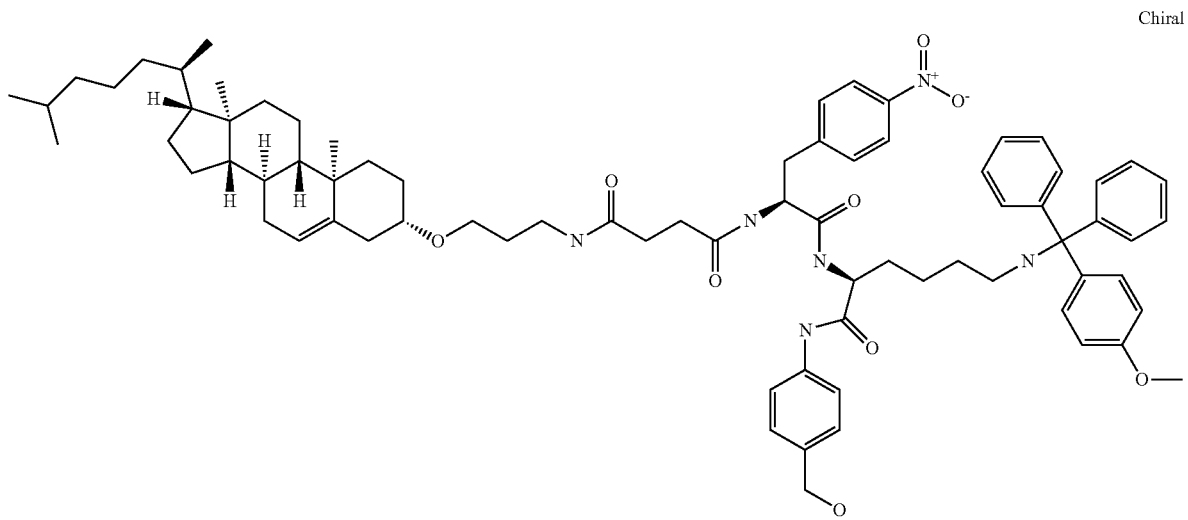

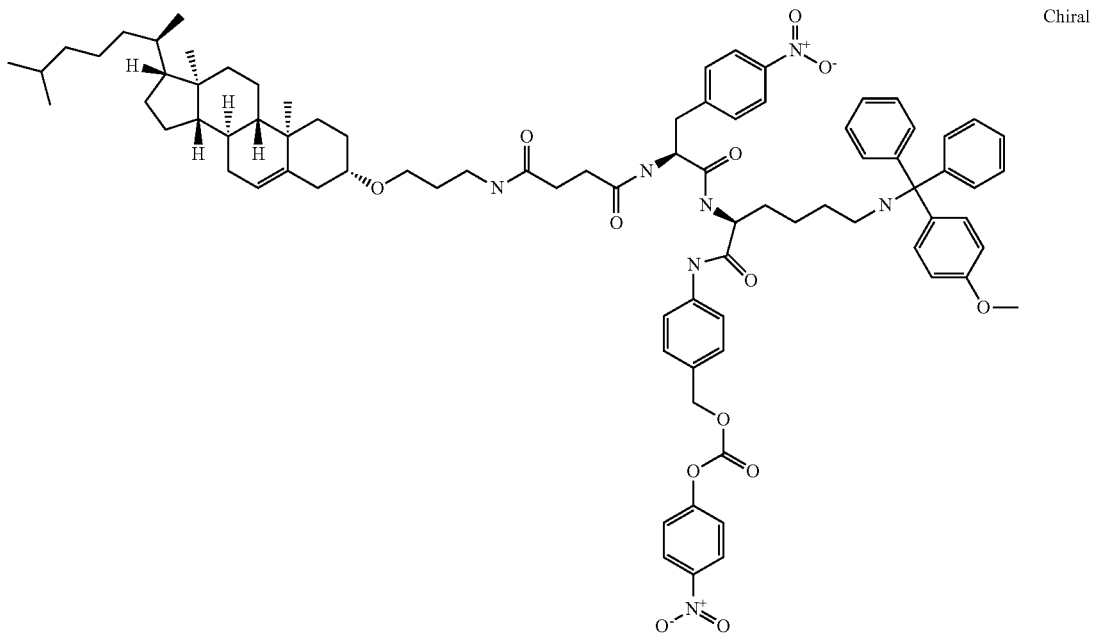

In a 10 mL round-bottomed flask, the above prepared N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-((S)-1-(4-(hydroxymethyl)phenylamino)-6-((4-methoxyphenyl)diphenylmethylamino)-1-oxohexan-2-ylamino)-3-(4-nitrophenyl)-1-oxopropan-2-yl)succinamide (126 mg, 101 µmol, Eq: 1.00) and Huenig's base (39.3 mg, 53.2 µl, 304 µmol, Eq: 3.00) were combined with CH₂Cl₂ (1.4 ml) and DMF (1.0 ml) to give a yellow suspension; bis(4-nitrophenyl) carbonate (46.3 mg, 152 µmol, Eq: 1.50) was added and the reaction allowed to proceed over night. The mixture was poured onto crashed ice, extracted 2× with AcOEt, washed with H₂O, dried over Na₂SO₄, and evaporated to dryness. After trituration with ~10 ml of diethyl ether, 99 mg of the title product was obtained as an off-white solid. MS: expected mass: 1405.7614, found mass: 1405.7518.

The necessary dipeptide building block for step 3 was prepared as follows:

Step a (S)-2-[(S)-2-(9H-Fluoren-9-ylmethoxycarbonylamino)-3-(4-nitro-phenyl)-propionylamino]-6-{[(4-methoxy-phenyl)-diphenyl-methyl]-amino}-hexanoic acid

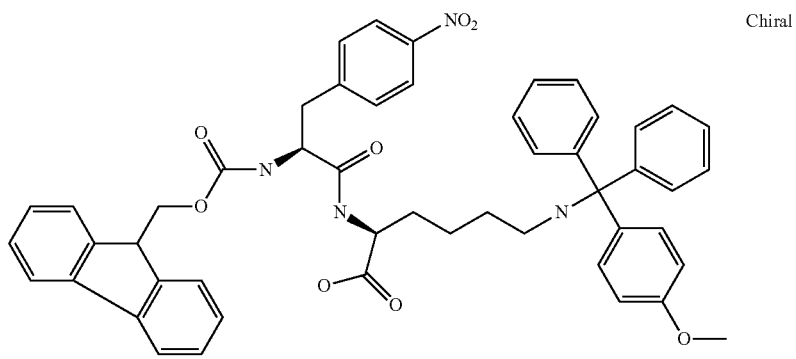 [SMILES: COc1ccc(C(NCCCC[C@H](NC(=O)[C@H](Cc2ccc([N+](=O)[O-])cc2)NC(=O)OCC2c3ccccc3-c3ccccc32)C(=O)O)(c2ccccc2)c2ccccc2)cc1 ; "Chiral"]

In a 25 mL round-bottomed flask, (S)-2-amino-6-((4-methoxyphenyl)diphenylmethyl-amino)hexanoic acid (Bioconjugate Chem. 2002, 13, 855-869, 968 mg, 2.31 mmol, Eq: 1.00) was dissolved in $CH_2Cl_2$ (20 ml) to give a light yellow solution. Huenig's base (897 mg, 1.21 ml, 6.94 mmol, Eq: 3.00) and trimethylchlorosilane (528 mg, 621 µl, 4.86 mmol, Eq: 2.10) were added and the reaction mixture was stirred for 15 min.

In a second 50 mL round-bottomed flask, (S)-2-(((9H-fluoren-9-yl)methoxy)carbonylamino)-3-(4-nitrophenyl)propanoic acid (1 g, 2.31 mmol, Eq: 1.00) was dissolved in DMF (20 ml) to give a colorless solution. Huenig's base (359 mg, 485 µl, 2.78 mmol, Eq: 1.20) and TPTU [125700-71-2] (687 mg, 2.31 mmol, Eq: 1.00) were added and the reaction mixture was stirred for 20'. The solution from the first flask containing the corresponding silyl ester monosilylamine was added and the reaction was stirred for another 3 hours. The mixture was poured onto crashed ice/$NH_4Cl$, extracted 2× with AcOEt, washed with $H_2O$ and brine, dried over $Na_2SO_4$, and evaporated to dryness. Flash chromatography $SiO_2$/10% MeOH/0.1% NEt3 in $CH_2Cl_2$ afforded 1.38 g of the title compound as brownish foam. MS (ISP): (M+H) 833.5, (M+Na) 855.4.

Step b

[(S)-1-((S)-1-(4-Hydroxymethyl-phenylcarbamoyl)-5-{[(4-methoxy-phenyl)-diphenyl-methyl]-amino}-pentylcarbamoyl)-2-(4-nitro-phenyl)-ethyl]-carbamic acid 9H-fluoren-9-ylmethyl ester In a 250 mL pear-shaped flask, the above synthesized (S)-2-(S)-2-(((9H-fluoren-9-yl)methoxy)carbonylamino)-3-(4-nitrophenyl)propanamido)-6-((4-methoxyphenyl)diphenyl-methylamino)hexanoic acid (1.38 g, 1.66 mmol, Eq: 1.00), (4-aminophenyl)methanol (204 mg, 1.66 mmol, Eq: 1.00), HOAt (226 mg, 1.66 mmol, Eq: 1.00) and EDC hydrochloride (318 mg, 1.66 mmol, Eq: 1.00) were dissolved in $CH_2Cl_2$ (16.6 ml) to give a yellow solution. Huenig's base (428 mg, 579 µl, 3.31 mmol, Eq: 2.00) was added and the reaction allowed to proceed over night. The mixture was poured onto crashed ice/NH4Cl (pH ~7), extracted 2× with AcOEt, washed with $H_2O$, dried over $Na_2SO_4$, and evaporated to dryness. The crude product was triturated with diethyl ether (1×50 mL); the resultant solid was filtered off and dryed to yield 1.214 g of the title compound as light-brown solid. MS (ISP): (M+H) 938.7.

Step c (S)-2-[(S)-2-Amino-3-(4-nitro-phenyl)-propionylamino]-6-{[(4-methoxy-phenyl)-diphenyl-methyl]-amino}-hexanoic acid (4-hydroxymethyl-phenyl)-amide

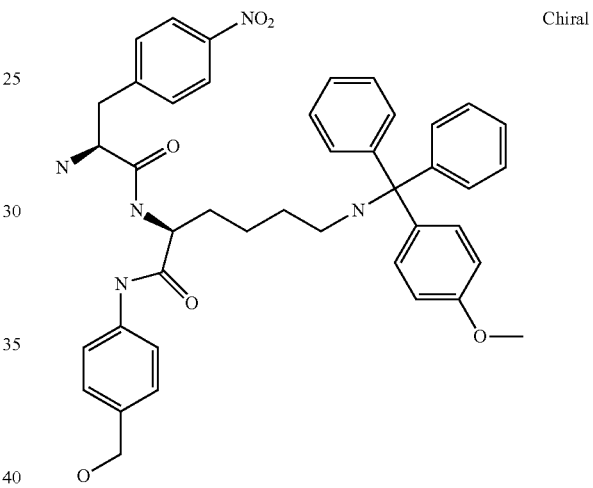

In a 50 mL round-bottomed flask, the above prepared [(S)-1-(S)-1-(4-hydroxymethyl-phenylcarbamoyl)-5-{[(4-methoxy-phenyl)-diphenyl-methyl]-amino}-pentylcarbamoyl)-2-(4-nitro-phenyl)-ethyl]-carbamic acid 9H-fluoren-9-ylmethyl ester (1.214 g, 1.29 mmol, Eq: 1.001) was combined with THF (19 ml) to give a brown solution. At 0°, diethylamine (1.77 g, 2.49 ml, 24.2 mmol, Eq: 18.70) was added. The reaction was stirred at ambient temperature for 3 h when MS indicated the disappearance of the starting material. All volatiles were evaporated i. V.; ensuing flash chromatography $SiO_2$/0.1% $NEt_3$ in CH2Cl2=>10% MeOH/0.1% $NEt_3$ in $CH_2Cl_2$, followed by a second flash chromatography $SiO_2$/5% MeOH/0.1% $NEt_3$ in $CH_2Cl_2$ afforded 502 mg of the title compound as light brown foam. MS: expected mass: 715.337, found mass: 715.3362.

Example 2

O-Benzyl-N-[4-({3-[(3beta)-cholest-5-en-3-yloxy]propyl}amino)-4-oxobutanoyl]-L-tyrosyl-N~6~-[(4-methoxyphenyl)(diphenyl)methyl]-N-[4-({[(4-nitrophenoxy)carbonyl]oxy}methyl)phenyl]-L-lysinamide

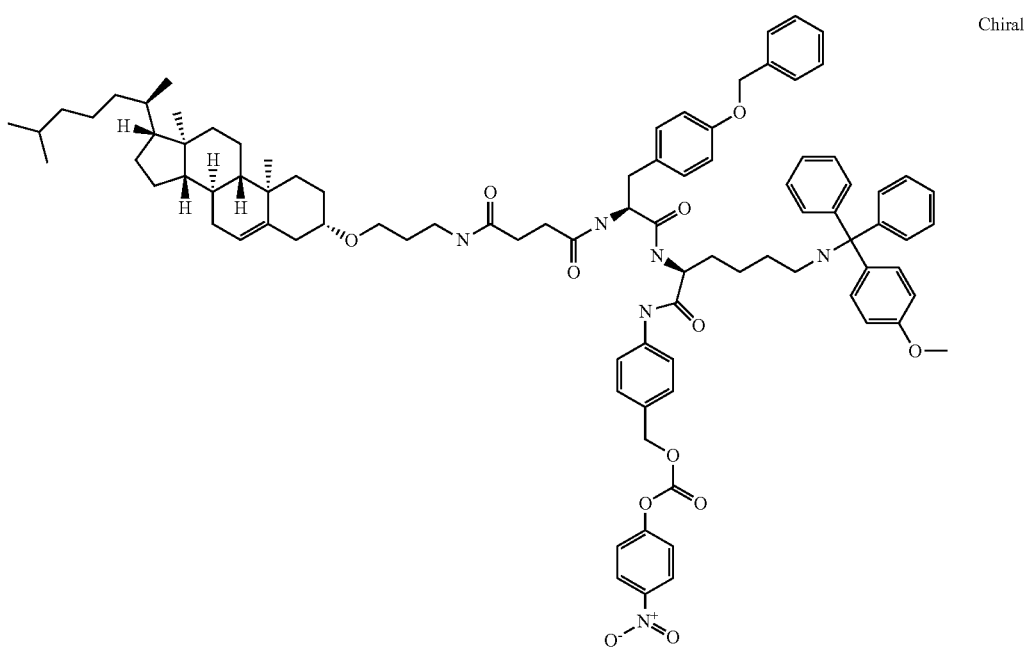

Was prepared in analogy to Example 1, but using in step 3 (S)-2-[(S)-2-amino-3-(4-benzyloxy-phenyl)-propionylamino]-6-{[(4-methoxy-phenyl)-diphenyl-methyl]-amino}-hexanoic acid (4-hydroxymethyl-phenyl)-amide instead of (S)-2-((S)-2-amino-3-(4-nitrophenyl)propanamido)-N-(4-(hydroxymethyl)phenyl)-6-((4-methoxyphenyl)diphenyl-methylamino)hexanamide as coupling partner. The former was prepared from (S)-2-(((9H-fluoren-9-yl)methoxy)carbonylamino)-3-(4-(benzyloxy)phenyl)propanoic acid as described above in steps a]-c]. MS: expected mass: 1466.8182, found mass: 1466.8136.

Example 3

N-[4-({3-[(3Beta)-cholest-5-en-3-yloxy]propyl}amino)-4-oxobutanoyl]-4-cyano-L-phenylalanyl-N-~6~-[(4-methoxyphenyl)(diphenyl)methyl]-N-[4-({[(4-nitrophenoxy)carbonyl]oxy}methyl)phenyl]-L-lysinamide

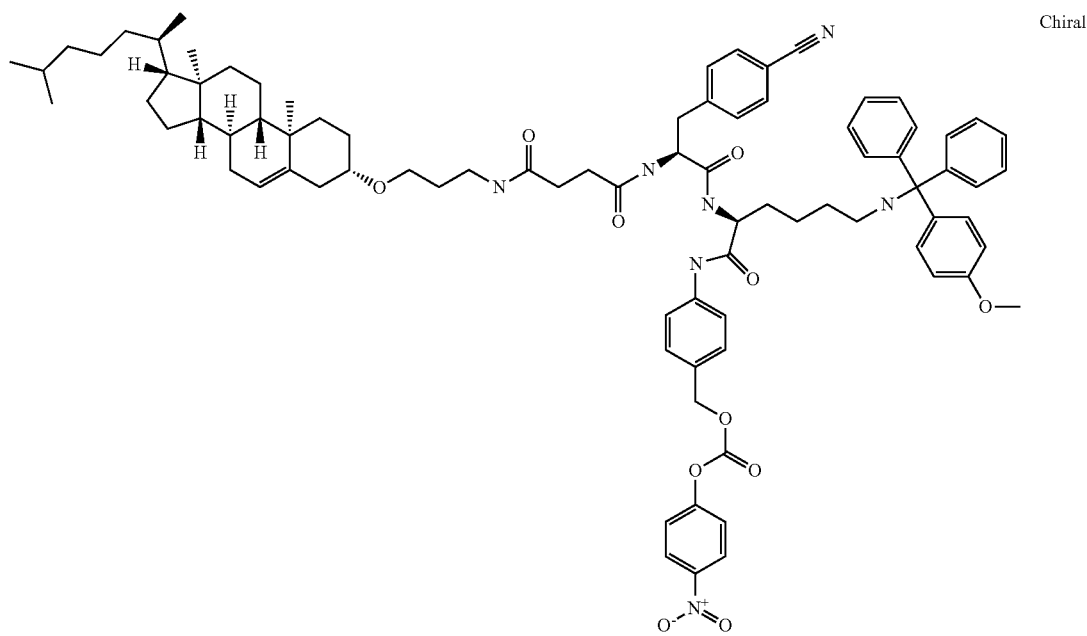

Was prepared in analogy to Example 1, but using in step 3 (S)-2-[(S)-2-amino-3-(4-cyano-phenyl)-propionylamino]-6-{[(4-methoxy-phenyl)-diphenyl-methyl]-amino}-hexanoic acid (4-hydroxymethyl-phenyl)-amide instead of (S)-2-(S)-2-amino-3-(4-nitrophenyl)-propanamido)-N-(4-(hydroxymethyl)phenyl)-6-((4-methoxyphenyl)diphenyl-methylamino)hexanamide as coupling partner. The former was prepared from (S)-2-(((9H-fluoren-9-yl)methoxy)carbonylamino)-3-(4-cyanophenyl)propanoic acid as described above in steps a]-c]. MS: expected mass: 1385.7716, found mass: 1385.7696.

Example 4

3,4-Dichloro-N-[4-({3-[(3beta)-cholest-5-en-3-yloxy]propyl}amino)-4-oxobutanoyl]-L-phenylalanyl-N-~6~-[(4-methoxyphenyl)(diphenyl)methyl]-N-[4-({[(4-nitrophenoxy)carbonyl]oxy}methyl)phenyl]-L-lysinamide

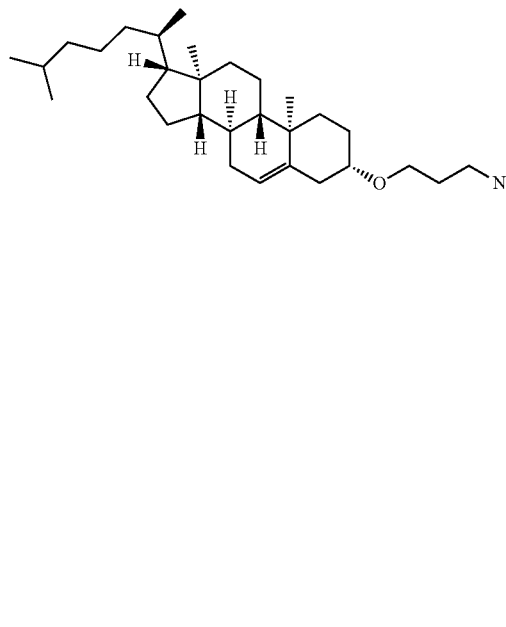
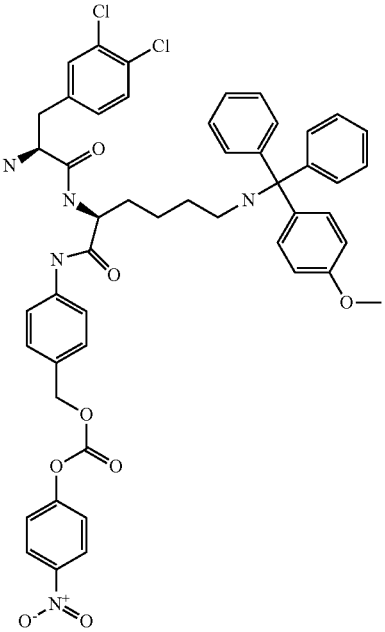

Was prepared in analogy to Example 1, but using in step 3 (S)-2-[(S)-2-amino-3-(3,4-dichloro-phenyl)-propionylamino]-6-{[(4-methoxy-phenyl)-diphenyl-methyl]-amino}-hexanoic acid (4-hydroxymethyl-phenyl)-amide instead of (S)-2-(S)-2-amino-3-(4-nitrophenyl)-propanamido)-N-(4-(hydroxymethyl)phenyl)-6-((4-methoxyphenyl) diphenyl-methylamino)hexanamide as coupling partner. The former was prepared from (S)-2-(((9H-fluoren-9-yl)methoxy)carbonylamino)-3-(3,4-dichlorophenyl)propanoic acid as described above in steps a]-c]. MS: expected mass: 1428.6984, found mass: 1428.695.

Example 5

4-Chloro-N-[4-({3-[(3beta)-cholest-5-en-3-yloxy]propyl}amino)-4-oxobutanoyl]-L-phenylalanyl-N-~6~-[(4-methoxyphenyl)(diphenyl)methyl]-N-[4-({[(4-nitrophenoxy)carbonyl]oxy}methyl)phenyl]-L-lysinamide

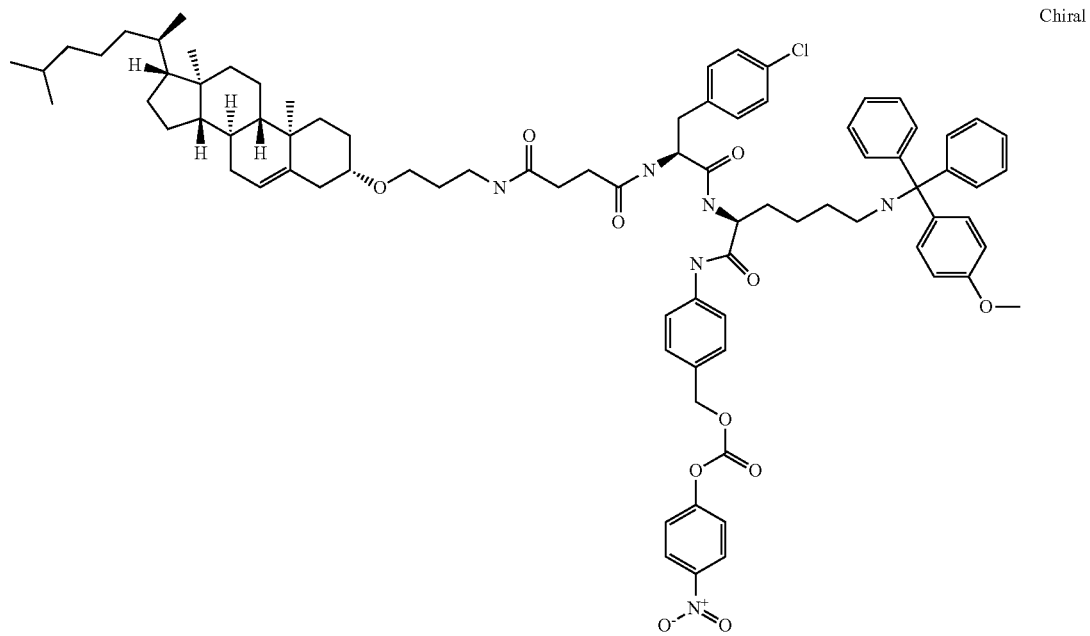

Was prepared in analogy to Example 1, but using in step 3 (S)-2-(S)-2-amino-3-(4-chlorophenyl)propanamido)-N-(4-(hydroxymethyl)phenyl)-6-((methoxyphenyl)diphenyl-methylamino)hexanamide instead of (S)-2-(S)-2-amino-3-(4-nitrophenyl)-propanamido)-N-(4-(hydroxymethyl)phenyl)-6-((methoxyphenyl)diphenyl-methylamino)hexanamide as coupling partner. The former was prepared from (S)-2-(9H-fluoren-9-yl)methoxy)-carbonylamino)-3-(4-chlorophenyl)propanoic acid as described above in steps a]-c]. MS: expected mass: 1394.7373, found mass: 1394.7342.

Example 6

4-{[(2S)-2-{[(2S)-2-[(4-{[3-({3S,8S,9S,10R,13R,14S,17R)-10,13-dimethyl-17-[(2R)-6-methylheptan-2-yl]-2,3,4,7,8,9,10,11,12,13,14,15,16,17-tetradecahydro-1H-cyclopenta[a]phenanthren-3-yl}oxy)propyl]amino}-4-oxobutanoyl)amino]-3-(naphthalen-1-yl)propanoyl]amino}-6-{[(4-methoxyphenyl)(diphenyl)methyl]amino}hexanoyl]amino}benzyl 4-nitrophenylcarbonate (non-preferred name)

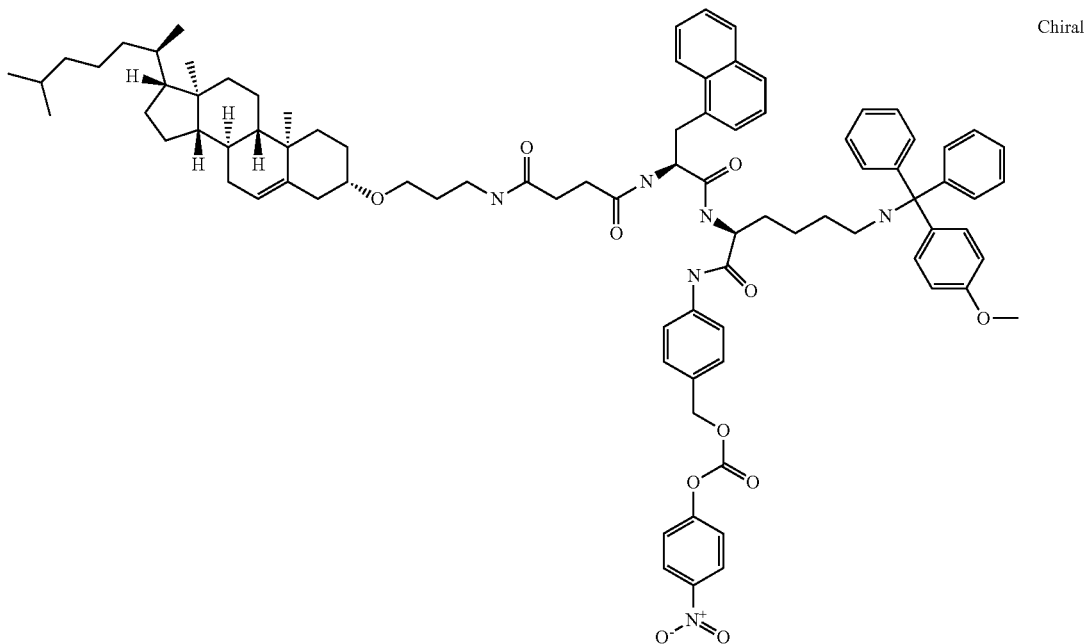

Was prepared in analogy to Example 1, but using in step 3 (S)-2-((S)-2-amino-3-naphthalen-1-yl-propionylamino)-6-{[(4-methoxy-phenyl)-diphenyl-methyl]-amino}-hexanoic acid (4-hydroxymethyl-phenyl)-amide instead of (S)-2-(S)-2-amino-3-(4-nitrophenyl)-propanamido)-N-(4-(hydroxymethyl)phenyl)-6-((4-methoxyphenyl)diphenyl-methylamino)hexanamide as coupling partner. The former was prepared from (S)-2-(((9H-fluoren-9-yl)methoxy)carbonylamino)-3-(naphthalen-1-yl)propanoic acid as described above in steps a]-c]. MS: expected mass: 1410.792, found mass: 1410.7918.

Example 7

N-[4-({3-[(3Beta)-cholest-5-en-3-yloxy]
propyl}amino)-4-oxobutanoyl]-4-fluoro-L-phenyla-
lanyl-N-~6~-[(4-methoxyphenyl)(diphenyl)methyl]-
N-[4-({[(4-nitrophenoxy)carbonyl]oxy}methyl)
phenyl]-L-lysinamide

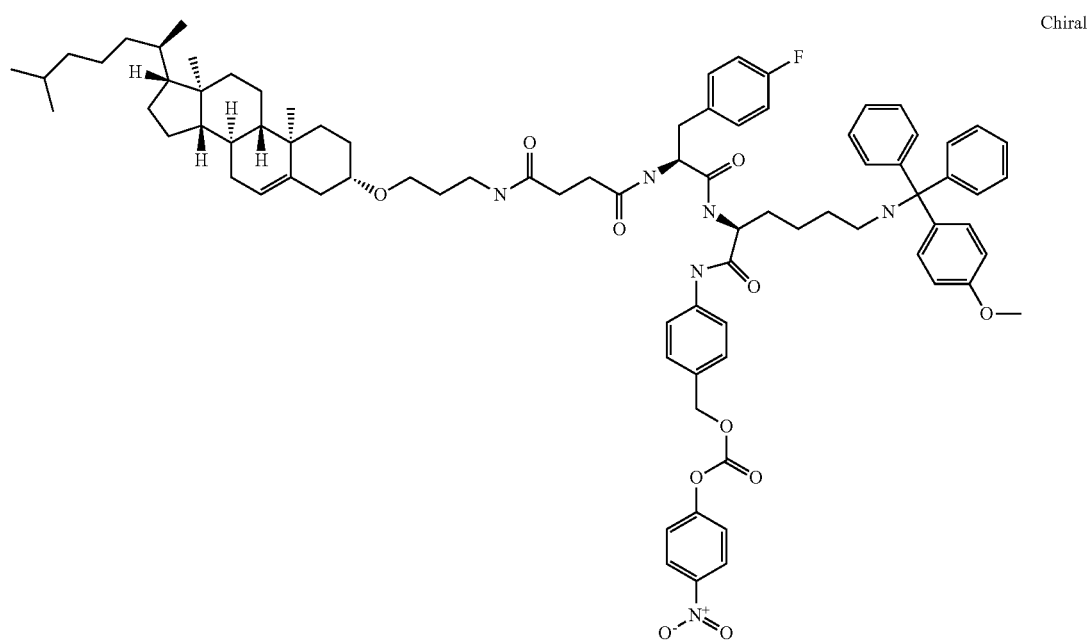

Was prepared in analogy to Example 1, but using in step 3 (S)-2-[(S)-2-amino-3-(4-fluoro-phenyl)-propionylamino]-6-{[(4-methoxy-phenyl)-diphenyl-methyl]-amino}-hexanoic acid (4-hydroxymethyl-phenyl)-amide instead of (S)-2-(S)-2-amino-3-(4-nitrophenyl)-propanamido)-N-(4-(hydroxymethyl)phenyl)-6-((4-methoxyphenyl)diphenyl-methylamino)-hexanamide as coupling partner. The former was prepared from (S)-2-(((9H-fluoren-9-yl)methoxy)carbonylamino)-3-(4-fluorophenyl)propanoic acid as described above in steps a]-c]. MS: expected mass: 1378.7669, found mass: 1378.7609.

Example 8

N-[4-({3-[(3Beta)-cholest-5-en-3-yloxy]propyl}amino)-4-oxobutanoyl]-2-fluoro-L-phenylalanyl-N-~6~-[(4-methoxyphenyl)(diphenyl)methyl]-N-[4-({[(4-nitrophenoxy)carbonyl]oxy}methyl)phenyl]-L-lysinamide

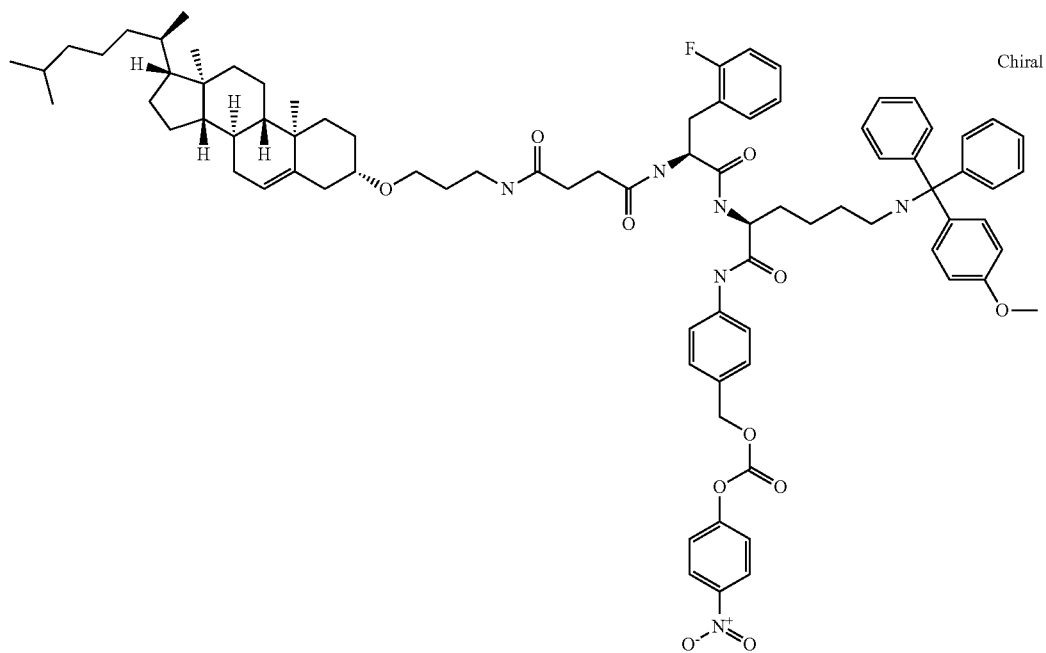

Was prepared in analogy to Example 1, but using in step 3 (S)-2-[(S)-2-Amino-3-(2-fluoro-phenyl)-propionylamino]-6-{[(4-methoxy-phenyl)-diphenyl-methyl]-amino}-hexanoic acid (4-hydroxymethyl-phenyl)-amide instead of (S)-2-(S)-2-amino-3-(4-nitrophenyl)-propanamido)-N-(4-(hydroxymethyl)phenyl)-6-((4-methoxyphenyl)diphenylmethylamino)-hexanamide as coupling partner. The former was prepared from (S)-2-(((9H-fluoren-9-yl)methoxy)carbonylamino)-3-(2-fluorophenyl)propanoic acid as described above in steps a]-c]. MS: expected mass: 1378.7669, found mass: 1378.7689.

Example 9

N-[4-({3-[(3Beta)-cholest-5-en-3-yloxy]propyl}amino)-4-oxobutanoyl]-3-fluoro-L-phenylalanyl-N-~6~-[(4-methoxyphenyl)(diphenyl)methyl]-N-[4-({[(4-nitrophenoxy)carbonyl]oxy}methyl)phenyl]-L-lysinamide

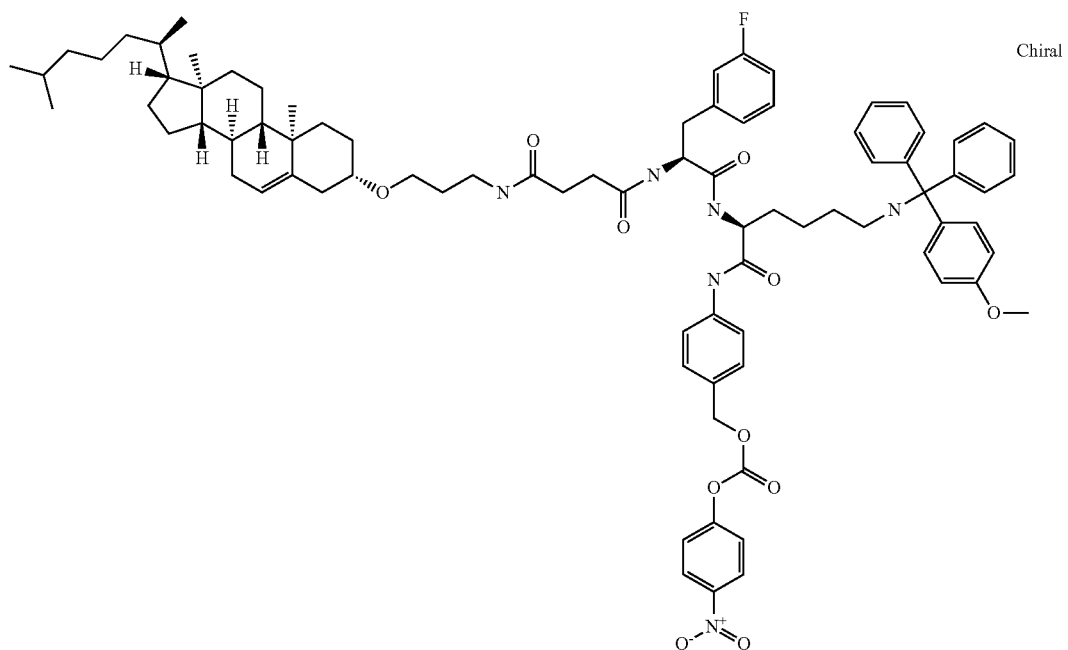

Was prepared in analogy to Example 1, but using in step 3 (S)-2-[(S)-2-amino-3-(3-fluoro-phenyl)-propionylamino]-6-{[(4-methoxy-phenyl)-diphenyl-methyl]-amino}-hexanoic acid (4-hydroxymethyl-phenyl)-amide instead of (S)-2-(S)-2-amino-3-(4-nitrophenyl)-propanamido)-N-(4-(hydroxymethyl)phenyl)-6-((4-methoxyphenyl)diphenyl-methylamino)-hexanamide as coupling partner. The former was prepared from (S)-2-(((9H-fluoren-9-yl)methoxy)carbonylamino)-3-(3-fluorophenyl)propanoic acid as described above in steps a]-c]. MS: expected mass: 1378.7669, found mass: 1378.7659.

Example 10

Step 1

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-(4-fluorophenyl)-4-4S)-1-(4-(hydroxymethyl)phenylamino)-6-((4-methoxyphenyl)diphenylmethylamino)-1-oxohexan-2-ylamino)-4-oxobutan-2-yl)succinamide

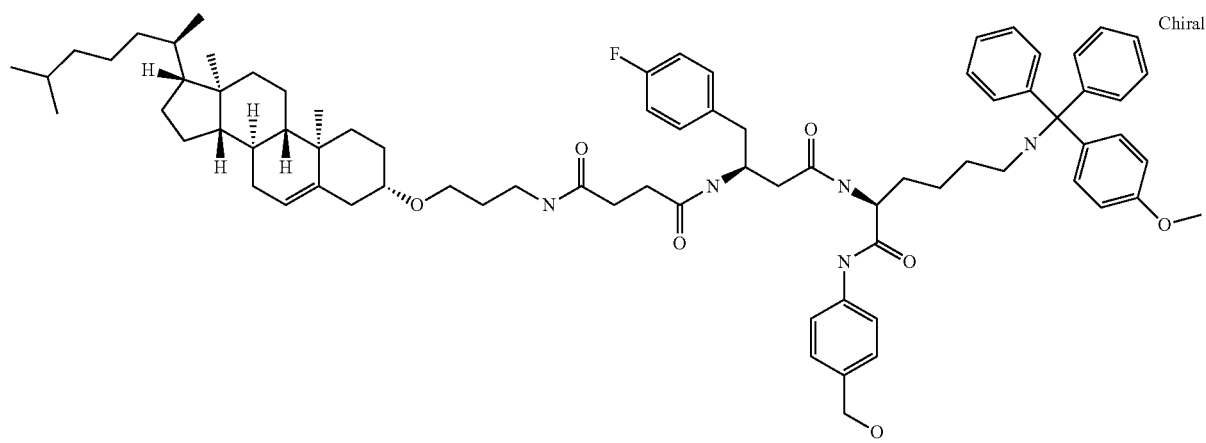

In a 10 mL round-bottomed flask, the above prepared 4-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propylamino)-4-oxobutanoic acid (109 mg, 188 µmol, Eq: 1.00), (S)-2-[(S)-3-amino-4-(4-fluoro-phenyl)-butyrylamino]-6-{[(4-methoxy-phenyl)-diphenyl-methyl]-amino}-hexanoic acid (4-hydroxymethyl-phenyl)-amide (132 mg, 188 µmol, Eq: 1.00), HOAt (25.6 mg, 188 µmol, Eq: 1.00) and EDC hydrochloride (36.1 mg, 188 µmol, Eq: 1.00) were mixed together in $CH_2Cl_2$ (2 ml) to give a yellow solution. Huenig's Base (48.7 mg, 64.1 µl, 377 µmol, Eq: 2.00) was added and the reaction stirred at ambient temperature over night. TLC indicated the consumption of starting material. All volatiles were removed i. V. and the crude product purified by flash chromatography $SiO_2$/5% MeOH/0.1% $NEt_3$ in $CH_2Cl_2$ to yield 197 mg of the title compound as off-white solid. MS: expected mass: 1227.7763, found mass: 1227.7714.

Step 2

4-((S)-2-((S)-3-(4-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propylamino)-4-oxobutanamido)-4-(4-fluorophenyl)butanamido)-6-((4-methoxyphenyl)diphenylmethylamino)hexanamido)-benzyl 4-nitrophenylcarbonate

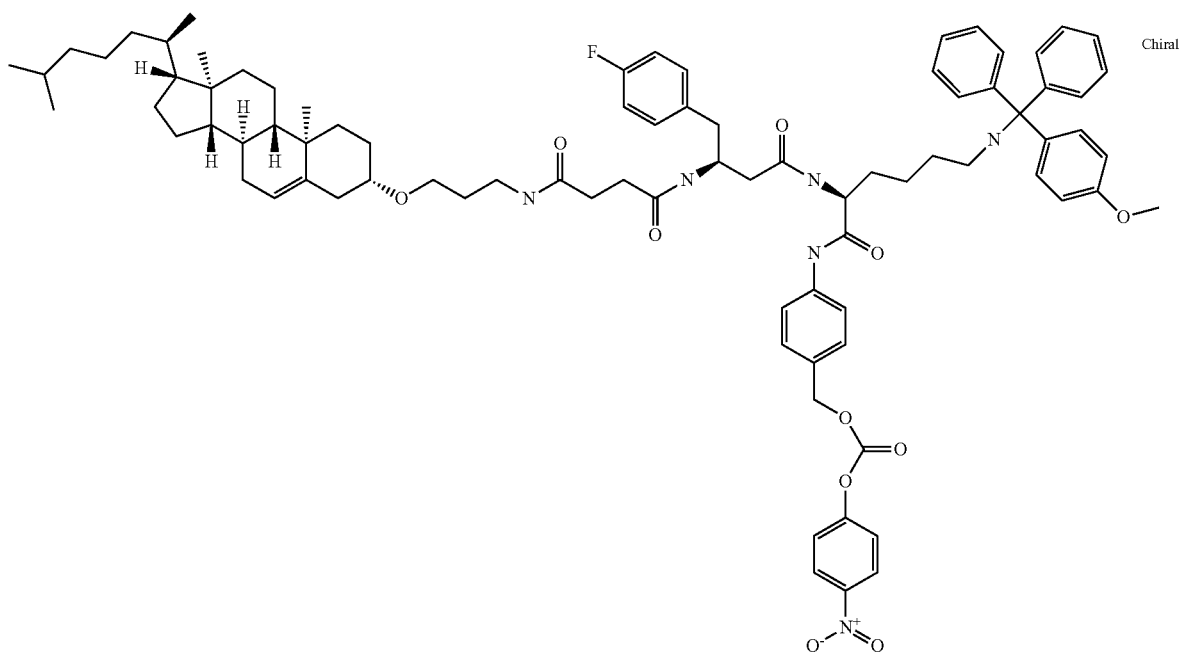

In a 10 mL round-bottomed flask, the above prepared N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-(4-fluorophenyl)-4-((S)-1-(4-(hydroxymethyl)phenylamino)-6-((4-methoxyphenyl)diphenylmethylamino)-1-oxohexan-2-ylamino)-4-oxobutan-2-yl)succinamide (196 mg, 160 μmol, Eq: 1.00) and Huenig's base (61.9 mg, 81.4 μl, 479 μmol, Eq: 3.00) were combined with $CH_2Cl_2$ (1.6 ml) and DMF (0.8 ml) to give a yellow suspension; bis(4-nitrophenyl) carbonate (72.8 mg, 239 μmol, Eq: 1.50) was added and the reaction allowed to proceed at ambient temperature over night. The mixture was poured onto crashed ice/$NH_4Cl$ (pH ~6), extracted 2× with AcOEt, washed with $H_2O$ and brine, dried over $Na_2SO_4$, and evaporated to dryness. After trituration with AcOEt/heptane one obtained 123 mg of the title compound as light yellow solid. MS: expected mass: 1392.7825, found mass: 1392.7819.

The necessary dipeptidic building block for step 1 was prepared as follows:

Step a (S)-2-[(S)-3-(9H-Fluoren-9-ylmethoxycarbonylamino)-4-(4-fluoro-phenyl)-butyrylamino]-6-{[(4-methoxy-phenyl)-diphenyl-methyl]-amino}-hexanoic acid

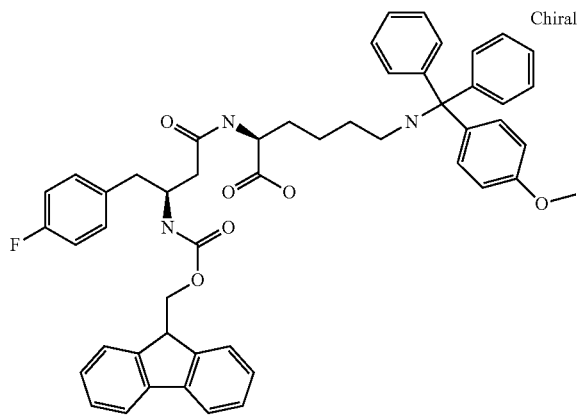 [SMILES: COc1ccc(C(NCCCC[C@H](NC(=O)C[C@H](Cc2ccc(F)cc2)NC(=O)OCC2c3ccccc3-c3ccccc32)C(=O)O)(c2ccccc2)c2ccccc2)cc1]

In a 25 mL round-bottomed flask, (S)-2-amino-6-((4-methoxyphenyl)diphenylmethyl-amino)hexanoic acid (Bioconjugate Chem. 2002, 13, 855-869, 1040 mg, 2.48 mmol, Eq: 1.00) was dissolved in CH$_2$Cl$_2$ (12.5 ml) to give a pale yellow solution. Huenig's base (961 mg, 1.27 ml, 7.44 mmol, Eq: 3.00) and trimethylchlorosilane (566 mg, 621 µl, 5.21 mmol, Eq: 2.10) were added and the reaction mixture was stirred at ambient temperature for 20 min.

In a second 50 mL round-bottomed flask, (S)-3-(((9H-fluoren-9-yl)methoxy)carbonyl-amino)-4-(4-fluorophenyl) butanoic acid (1040 mg, 2.48 mmol, Eq: 1.00) was dissolved in DMF (12.5 ml) to give a colorless solution. Huenig's base (385 mg, 506 µl, 2.98 mmol, Eq: 1.20) and TPTU [125700-71-2] (737 mg, 2.48 mmol, Eq: 1.00) were added and the reaction mixture was stirred for 15 min. The solution from the first flask containing the corresponding silyl ester monosilylamine was added and the reaction was stirred for another 3 hours at ambient temperature. The mixture was poured onto crashed ice/NH$_4$Cl, extracted 2× with AcOEt, washed with H$_2$O and brine, dried over Na$_2$SO$_4$, and evaporated to dryness. Flash chromatography SiO$_2$/5% MeOH/0.1% NEt3 in CH$_2$Cl$_2$ afforded 2.10 g of the title compound as yellow foam. MS (ISP): (M+H) 820.6.

Step b

{(S)-2-(4-Fluoro-phenyl)-1-[((S)-1-(4-hydroxymethyl-phenylcarbamoyl)-5-{[(4-methoxy-phenyl)-diphenyl-methyl]-amino}-pentylcarbamoyl)-methyl]-ethyl}-carbamic acid 9H-fluoren-9-ylmethyl ester

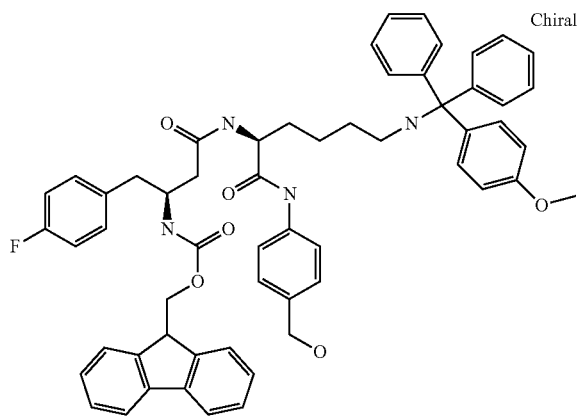 [SMILES: COc1ccc(C(NCCCC[C@H](NC(=O)C[C@H](Cc2ccc(F)cc2)NC(=O)OCC2c3ccccc3-c3ccccc32)C(=O)Nc2ccc(CO)cc2)(c2ccccc2)c2ccccc2)cc1]

In a 250 mL pear-shaped flask, the above synthesized {(S)-2-(4-fluoro-phenyl)-1-[((S)-1-(4-hydroxymethyl-phenylcarbamoyl)-5-{[(4-methoxy-phenyl)-diphenyl-methyl]-amino}pentylcarbamoyl)-methyl]-ethyl}-carbamic acid 9H-fluoren-9-ylmethyl ester (2.10 g, 2.56 mmol, Eq: 1.00), (4-aminophenyl)methanol (315 mg, 2.55 mmol, Eq: 1.00), HOAt (349 mg, 2.56 mmol, Eq: 1.00) and EDC hydrochloride (491 mg, 2.56 mmol, Eq: 1.00) were dissolved in CH$_2$Cl$_2$ (12.5 ml). Huenig's base (662 mg, 871 µl, 5.21 mmol, Eq: 2.00) was added and the reaction allowed to proceed over night. The mixture was poured onto crashed ice/NH$_4$Cl (pH ~7), extracted 2× with AcOEt, washed with H2O and brine, dried over Na$_2$SO$_4$, and evaporated to dryness. The crude product was triturated with diethyl ether (1×50 ml); the resultant solid was filtered off and dryed to yield 0.796 g of the title compound as light-brown solid.

MS (ISP): (M+H) 925.6.

Step c (S)-2-[(S)-3-Amino-4-(4-fluoro-phenyl)-butyrylamino]-6-{[(4-methoxy-phenyl)-diphenyl-methyl]-amino}-hexanoic acid (4-hydroxymethyl-phenyl)-amide

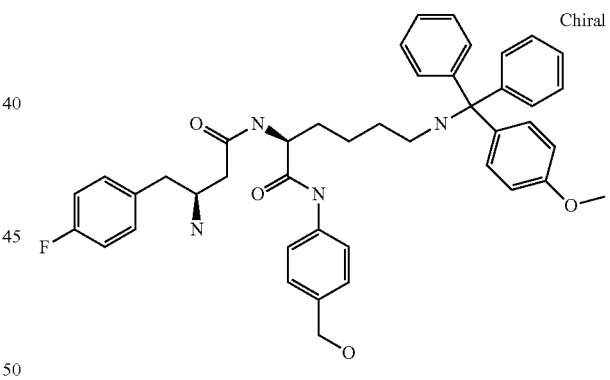

In a 50 mL round-bottomed flask, the above prepared {(S)-2-(4-fluoro-phenyl)-1-R(S)-1-(4-hydroxymethyl-phenylcarbamoyl)-5-{[(4-methoxy-phenyl)-diphenyl-methyl]-amino}-pentylcarbamoyl)-methyl]-ethyl}-carbamic acid 9H-fluoren-9-ylmethyl ester (793 mg, 857 umol, Eq: 1.001) was combined with THF (12 ml) to give a brownish solution. At 0°, diethylamine (1.13 g, 1.59 ml, 15.4 mmol, Eq: 18) was added. The reaction was stirred at ambient temperature over night. The mixture was poured onto crashed ice/NH4Cl (pH ~7), extracted 2× with AcOEt, washed with H$_2$O and brine, dried over Na$_2$SO$_4$, and evaporated to dryness. Flash chromatography SiO$_2$/10% MeOH/0.1% NEt$_3$ in CH$_2$Cl$_2$ yielded 500 mg of the title compound as off-white solid. MS: expected mass: 702.3581, found mass: 702.3578.

Example 11

4-((S)-2-((S)-3-(4-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propylamino)-4-oxobutanamido)-4-phenylbutanamido)-6-((4-methoxyphenyl)diphenylmethylamino)hexanamido) benzyl 4-nitrophenylcarbonate

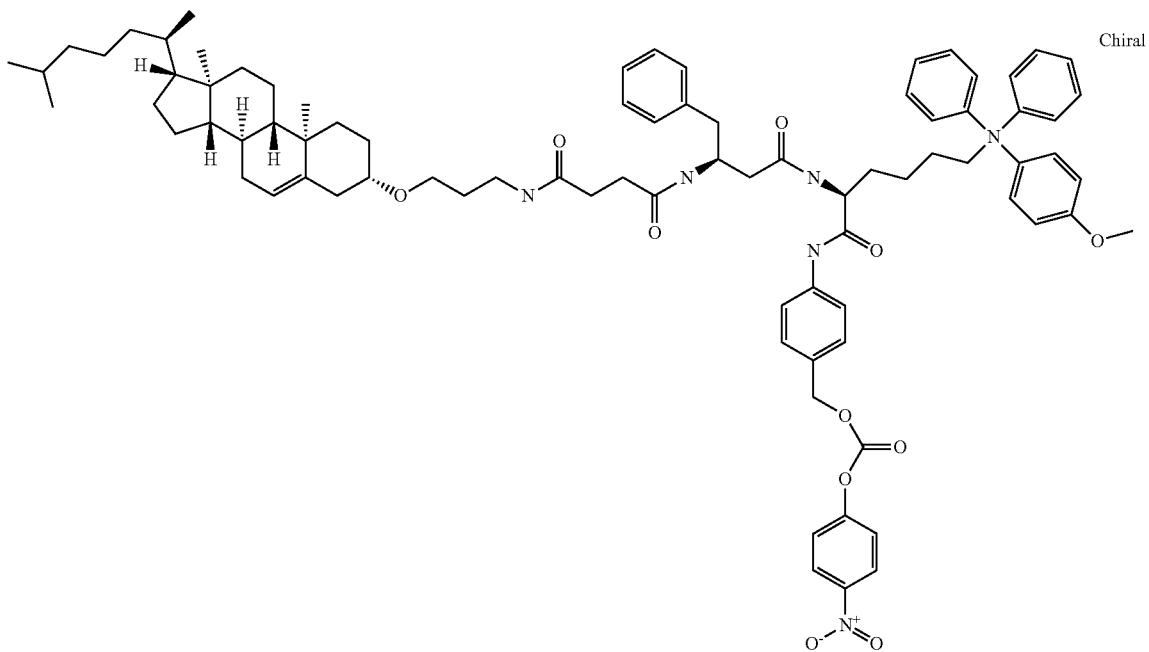

Was prepared in analogy to Example 10, but using in step 1 (S)-2-(S)-3-amino-4-phenylbutanamido)-N-(4-(hydroxymethyl)phenyl)-6-((4-methoxyphenyl)diphenyl-methylamino)hexanamide instead of (S)-2-[(S)-3-amino-4-(4-fluoro-phenyl)-butyrylamino]-6-{[(4-methoxy-phenyl)-diphenyl-methyl]-amino}-hexanoic acid (4-hydroxymethyl-phenyl)-amide as coupling partner. The former was prepared from (S)-3-(((9H-fluoren-9-yl)methoxy)carbonylamino)-4-phenylbutanoic acid as described above in steps a]-c].

MS: expected mass: 1374.792, found mass: 1374.7877.

Example 12

4-({N~2~-[(3S)-4-(4-chlorophenyl)-3-{[4-({3-[(3beta)-cholest-5-en-3-yloxy]propyl}amino)-4-oxobutanoyl]amino}butanoyl]-N-~6~-[(4-methoxyphenyl)(diphenyl)methyl]-L-lysyl}amino)benzyl 4-nitrophenylcarbonate

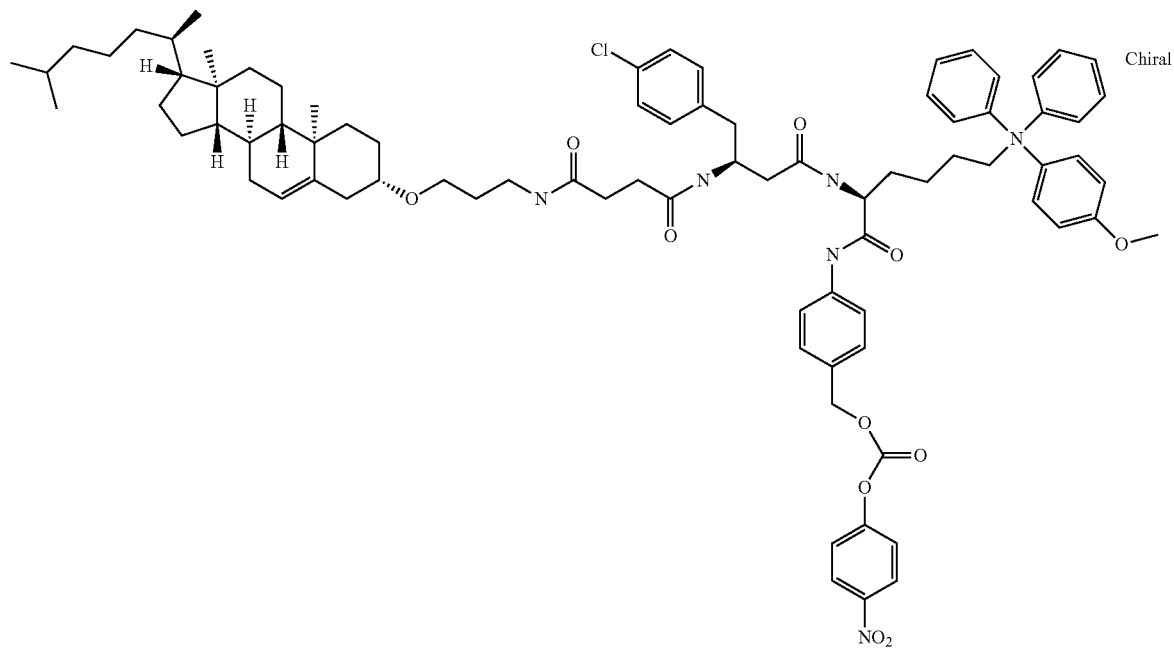

Was prepared in analogy to example 10, but using in step 1 (S)-2-(S)-3-amino-4-(4-chlorophenyl)butanamido)-N-(4-(hydroxymethyl)phenyl)-6-((4-methoxyphenyl)-diphenylmethylamino)hexanamide instead of (S)-2-[(S)-3-amino-4-(4-fluoro-phenyl)-butyrylamino]-6-{[(4-methoxy-phenyl)-diphenyl-methyl]-amino}-hexanoic acid (4-hydroxymethyl-phenyl)-amide as coupling partner. The former was prepared from (S)-3-[((9H-fluoren-9-yl)methoxy)carbonylamino)-4-(4-chlorophenyl)-butanoic acid as described above in steps a]-c]. MS (ISP): (M+H) 1409.9.

Example 13

N-[4-({3-[(3Beta)-cholest-5-en-3-yloxy]propyl}amino)-4-oxobutanoyl]-O-methyl-L-tyrosyl-N-~6~-[(4-methoxyphenyl)(diphenyl)methyl]-N-[4-({[(4-nitrophenoxy)carbonyl]oxy}methyl)phenyl]-L-lysinamide

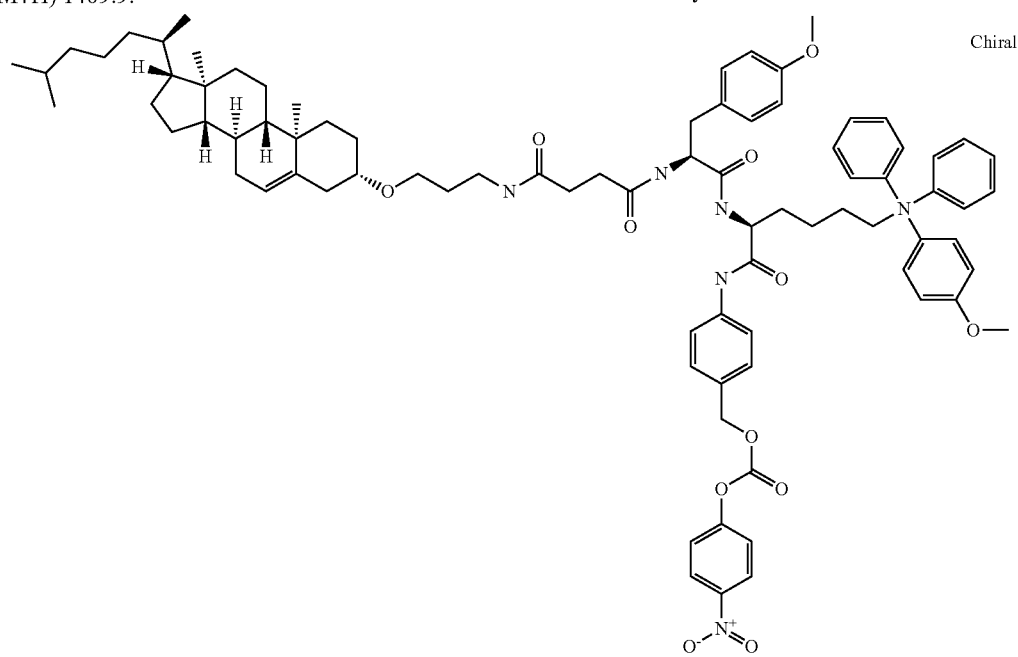

Was prepared in analogy to Example 1, but using in step 3 (S)-2-((S)-2-amino-3-(4-methoxyphenyl)propanamido)-N-(4-(hydroxymethyl)phenyl)-6-((4-methoxyphenyl)-diphenylmethylamino)hexanamide instead of (S)-2-(S)-2-amino-3-(4-nitrophenyl)-propanamido)-N-(4-(hydroxymethyl)phenyl)-6-((4-methoxyphenyl)diphenyl-methylamino)hexanamide as coupling partner. The former was prepared from (S)-2-(((9H-fluoren-9-yl)methoxy)carbonylamino)-3-(4-methoxyphenyl)propanoic acid as described above in steps a]-c] of example 1. MS (ISP): (M+H) 1391.9.

Example 14

N-[4-({3-[(3Beta)-cholest-5-en-3-yloxy]propyl}amino)-4-oxobutanoyl]-D-phenylalanyl-N~6~-[(4-methoxyphenyl)(diphenyl)methyl]-N-[4-({[(4-nitrophenoxy)carbonyl]oxy}methyl)phenyl]-D-lysinamide

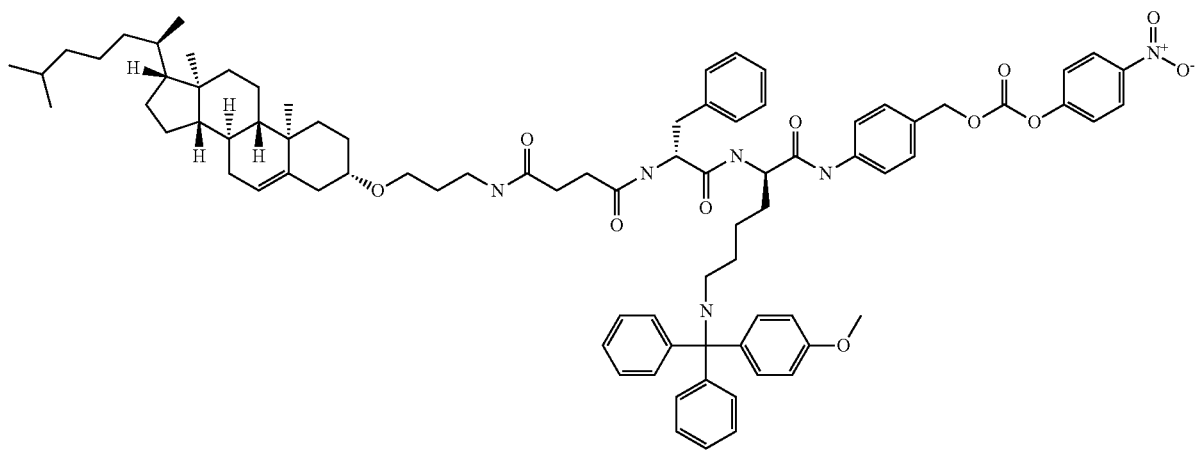

Was prepared in analogy to example 1, but using in step 3 (R)-2-(R)-2-amino-3-phenyl-propanamido)-N-(4-(hydroxymethyl)phenyl)-6-((methoxyphenyl)diphenylmethylamino)-hexanamide instead of (S)-2-(S)-2-amino-3-(4-nitrophenyl)-propanamido)-N-(4-(hydroxymethyl)phenyl)-6-((methoxyphenyl)diphenyl-methylamino)hexanamide as coupling partner. This building block was synthesized from (R)-2-(((9H-fluoren-9-yl)methoxy)carbonylamino)-6-aminohexanoic acid and (R)-2-amino-6-((methoxyphenyl)-diphenylmethylamino)hexanoic acid (see Bioconjugate Chem. 2002, 13, 885-869) as described above in steps a]-c]. MS: expected mass: 1360.7763, found mass: 1360.7774.

Example 15

4-({N~2~-[(3S)-3-{[4-({3-[(3Beta)-cholest-5-en-3-yloxy]propyl}amino)-4-oxobutanoyl]amino}-4-(4-cyanophenyl)butanoyl]-N~6~-[(4-methoxyphenyl)(diphenyl)methyl]-L-lysyl}amino)benzyl 4-nitrophenylcarbonate

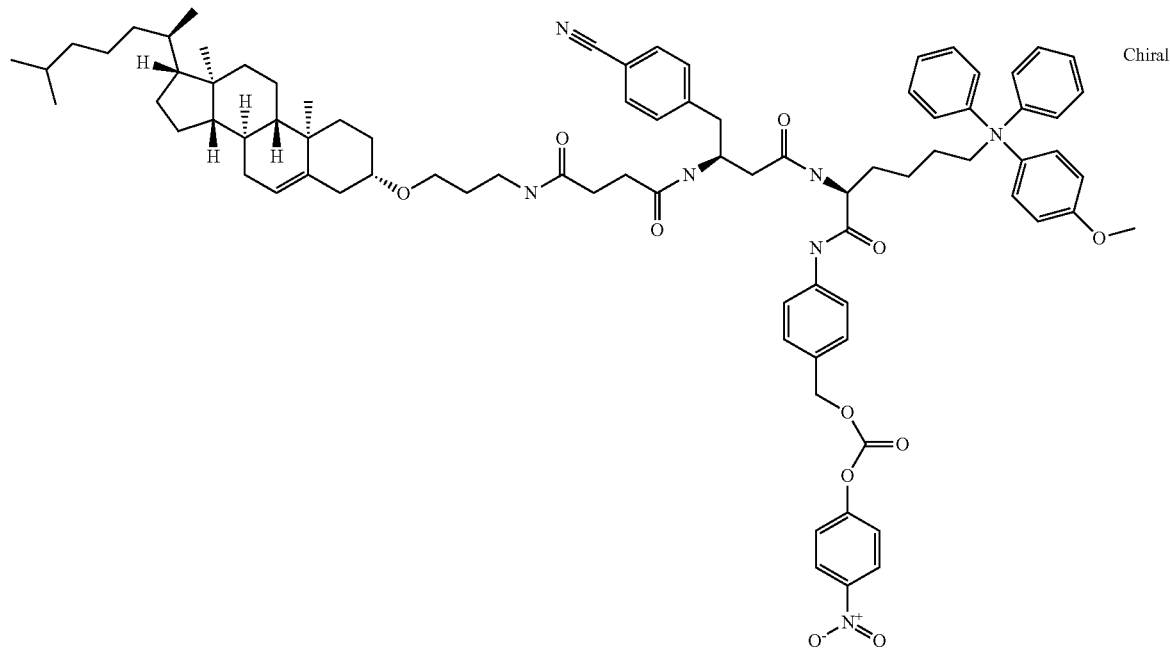

Was prepared in analogy to example 10, but using in step 1 (S)-2-(S)-3-amino-4-(4-cyanophenyl)butanamido)-N-(4-(hydroxymethyl)phenyl)-6-((4-methoxyphenyl)diphenylmethylamino)hexanamide instead of (S)-2-[(S)-3-amino-4-(4-fluoro-phenyl)-butyrylamino]-6-{[(4-methoxy-phenyl)-diphenyl-methyl]-amino}-hexanoic acid (4-hydroxymethyl-phenyl)-amide as coupling partner. The former was prepared from (S)-3-(((9H-fluoren-9-yl)methoxy)carbonylamino)-4-(4-cyanophenyl)butanoic acid as described above in steps a]-c].

MS: expected mass: 1399.7872, found mass: 1399.7857.

Example 16

N-[4-({3-[(3beta)-cholest-5-en-3-yloxy]propyl}amino)-4-oxobutanoyl]-L-phenylalanyl-N~6~-[(4-methoxyphenyl)(diphenyl)methyl]-N-[4-({[(4-nitrophenoxy)carbonyl]oxy}methyl)phenyl]-L-lysinamide

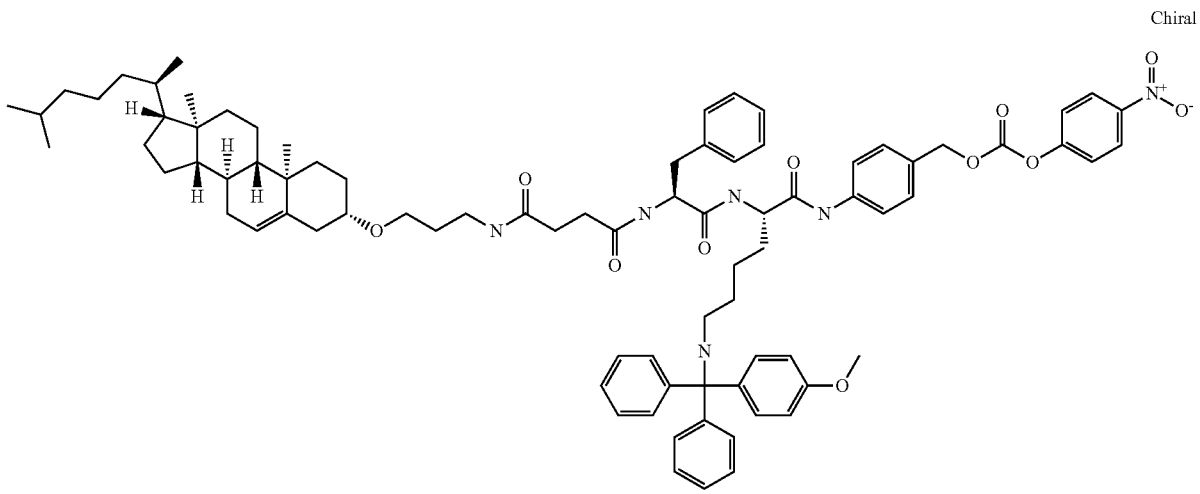

Step 1

(S)-2-((S)-2-Amino-3-phenyl-propionylamino)-6-{[(4-methoxy-phenyl)-diphenyl-methyl]-amino}-hexanoic acid (4-hydroxymethyl-phenyl)-amide

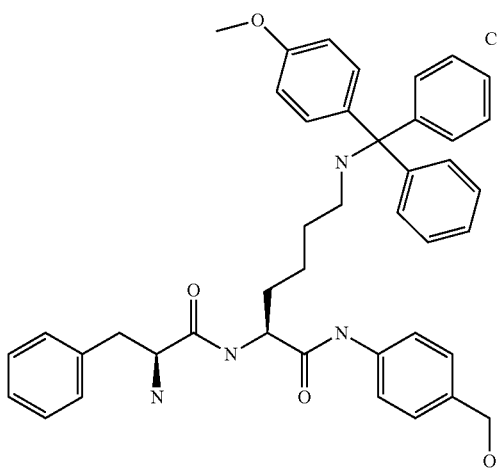

The building block (S)-2-((S)-2-amino-3-phenyl-propionylamino)-6-{[(4-methoxy-phenyl)-diphenyl-methyl]-amino}-hexanoic acid (4-hydroxymethyl-phenyl)-amide was prepared in analogy to the procedure described in Bioconjugate Chem., Vol. 13, No. 4, 2002, 855-869.

MS (ISP): (M+H) 671.5

Step 2

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-((S)-1-(4-(hydroxymethyl)phenylamino)-6-((4-methoxyphenyl)diphenylmethylamino)-1-oxohexan-2-ylamino)-1-oxo-3-phenylpropan-2-yl)succinamide TPTU [125700-71-2] (233 mg, 784 µmol, Eq: 1.00) was added to a solution of N-{3-[(3S,8S,9S,10R,13R,14S,17R)-17-((R)-1,5-dimethyl-hexyl)-10,13-dimethyl-2,3,4,7,8,9,10,11,12,13,14,15,16,17-tetradecahydro-1H-cyclopenta[a]phenanthren-3-yloxy]-propyl}-succinamic acid (see example 1, step 2) (426 mg, 0.784 mmol, Eq: 1.00) and Huenig's base (304 mg, 411 µl, 2.35 mmol, Eq: 3) in DMF (10 ml). After 3 minutes (S)-2-((S)-2-amino-3-phenyl-propionylamino)-6-{[(4-methoxy-phenyl)-diphenyl-methyl]-amino}-hexanoic acid (4-hydroxymethyl-phenyl)-amide (step 1) was added TLC at t=1 h showed the reaction was complete. The solvent was removed under reduced pressure. The remaining residue was taken up in ethyl acetate and extracted with NaHCO₃ half sat. solution (1×), potassium hydrogen phthalate solution 0.05M (2×), water (1×) and brine (1×). The organic extract was dried over MgSO₄ and concentrated under reduced pressure. The crude material was purified by flash chromatography to obtain the titled product (682 mg, 513, µmol) as a light brown solid. MS (ISP): (M+H) 1196.8

Step 3

Hünig's base (465 mg, 629 µl, 3.6 mmol, Eq: 6) was added to a solution of the previous alcohol (718 mg, 600 µmol, Eq: 1.00) and bis(4-nitrophenyl) carbonate (548 mg, 1.8 mmol, Eq: 3) in THF (20 ml). The yellow solution was stirred overnight at room temperature. The solvent was removed under reduced pressure. The remaining residue was triturated with diethyl ether. The solid was collected by filtration, washed with ether and dried under reduced pressure to obtain the title compound (800 mg, 529 µmmol) as a light brown solid. MS (ISP): (M+H) 1361.9

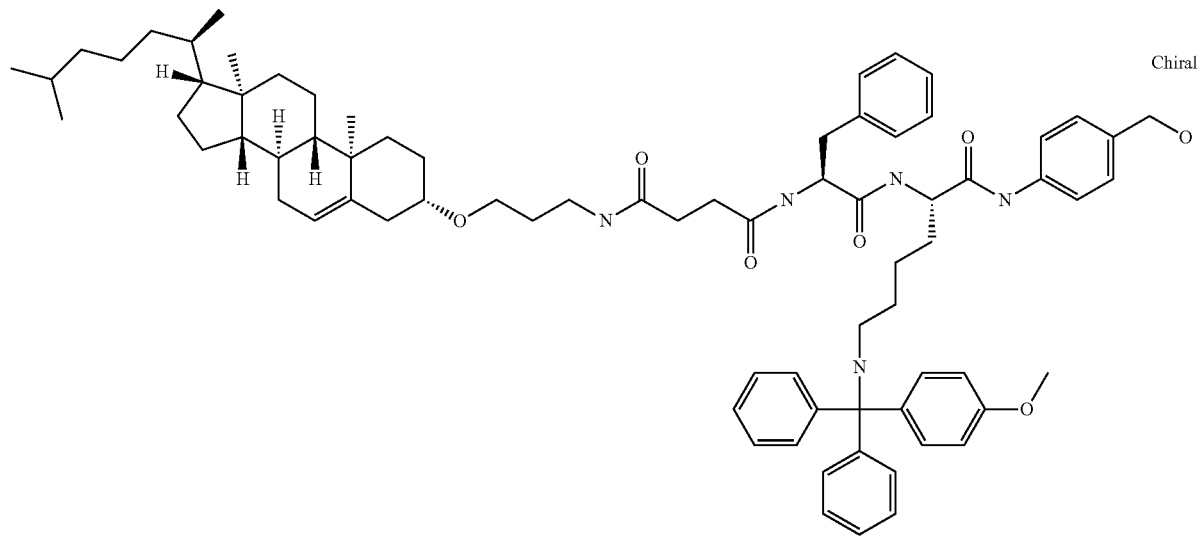

Example 17

Step 1

(S)-2-[(S)-2-(9H-Fluoren-9-ylmethoxycarbonylamino)-3-phenyl-propionylamino]-hexanoic acid

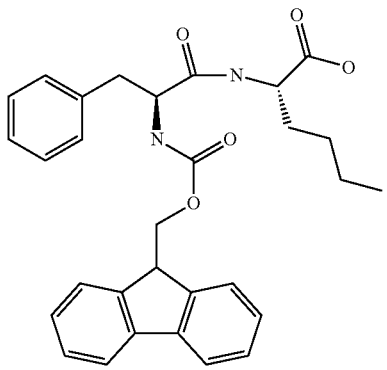 [SMILES: CCCC[C@H](NC(=O)[C@H](Cc1ccccc1)NC(=O)OCC1c2ccccc2-c2ccccc21)C(=O)O]

Commercially available L-Fmoc-Phe-OSu (0.969 g, 2.00 mmol, Eq: 1.00) was suspended in a 1:1 v/v mixture of 1,2-dimethoxyethane and water (17 ml) and treated at 0° C. with L-norleucine (0.275 g, 2.10 mmoll, Eq: 1.05) and NaHCO$_3$ (0.185 g, 2.20 mmol, Eq: 1.10). The cooling bath was removed and the reaction allowed to proceed at ambient temperature for 14 h. The mixture was poured onto crashed ice/citric acid (pH ~3), extracted 2× with ethyl acetate, washed with H$_2$O and brine, dried over Na$_2$SO$_4$, and evaporated to dryness. Flash chromatography SiO$_2$/AcOEt yielded 0.870 mg of the title compound as white solid. MS (ISP): (M+H) 501.2.

Step 2

{(S)-1-[(S)-1-(4-Hydroxymethyl-phenylcarbamoyl)-pentylcarbamoyl]-2-phenyl-ethyl}-carbamic acid 9H-fluoren-9-ylmethyl ester

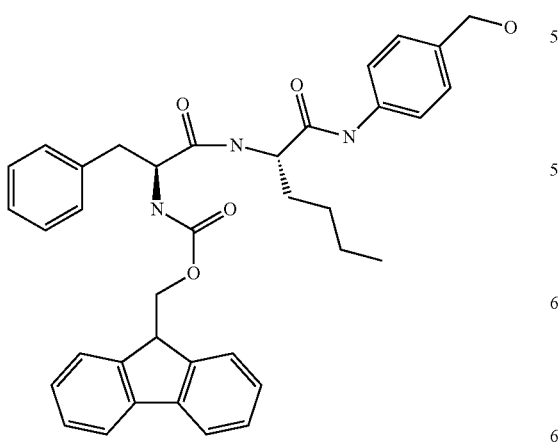

In a pear-shaped flask, the above synthesized (S)-2-[(S)-2-(9H-fluoren-9-ylmethoxy-carbonylamino)-3-phenyl-propionylamino]-hexanoic acid (10.72 g, 21 mmol, Eq: 1.00), (4-aminophenyl)methanol (2.717 g, 22 mmol, Eq: 1.03), and 2-ethoxy-1-ethoxycarbonyl-1,2-dihydroquinoline (EEDQ) (7.994 g, 32 mmol, Eq: 1.50) were dissolved in CH$_2$Cl$_2$ (320 ml) and stirred over night under a balloon of Ar. The mixture was poured onto crashed ice/NH4Cl, extracted 2× with AcOEt, washed with H$_2$O, dried over Na$_2$SO$_4$, and the volume reduced to ~300 ml. The precipitate was filtered off and dryed to give 5.25 g of the title compound as light-brown solid. MS (ISP): (M+H) 606.3.

Step 3

(S)-2-((S)-2-Amino-3-phenyl-propionylamino)-hexanoic acid (4-hydroxymethyl-phenyl)-amide

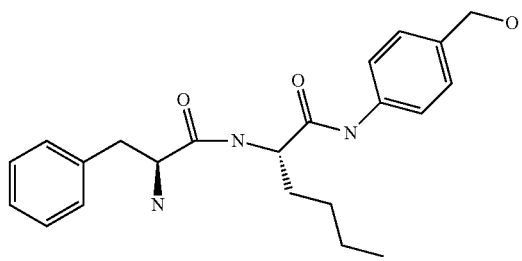 [SMILES: CCCC[C@H](NC(=O)[C@@H](N)Cc1ccccc1)C(=O)Nc1ccc(CO)cc1]

In a round-bottomed flask, the above prepared {(S)-1-[(S)-1-(4-hydroxymethyl-phenylcarbamoyl)-pentylcarbamoyl]-2-phenyl-ethyl}-carbamic acid 9H-fluoren-9-ylmethyl ester (4.738 g, 7.822 mmol, Eq: 1.0) was dissolved in CH$_2$Cl$_2$ (28 ml). At 0°, diethylamine (28 ml, 19.80 g, 271 mmol, Eq: 35) was added and the reaction mixture stirred at ambient temperature over night. All volatiles were evaporated i. V.; ensuing flash chromatography SiO$_2$/CH$_2$Cl$_2$/10% MeOH, followed by crystallization from AcOEt, yielded 2.116 g of the title compound as light brown crystals. MS (ISP): (M+H) 384.2.

Step 4

N1-(3-((3S,8S,9S,10R,13R,14S,17R)-10,13-dim-
ethyl-17-((R)-6-methylheptan-2-yl)-2,3,4,7,8,9,10,
11,12,13,14,15,16,17-tetradecahydro-1H-cyclopenta
[a]phenanthren-3-yloxy)propyl)-N4-((S)-1-((S)-1-(4-
(hydroxymethyl)phenylamino)-1-oxohexan-2-
ylamino)-1-oxo-3-phenylpropan-2-yl)succinamide

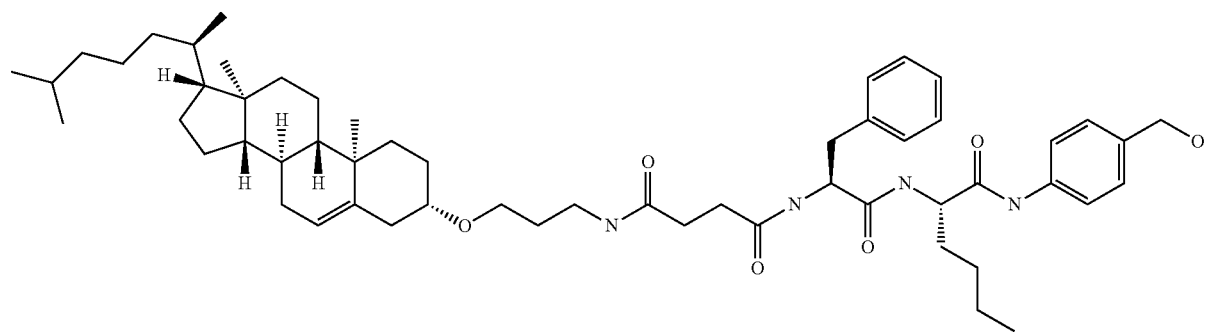

was prepared therewith in analogy to example 16 step 2. MS (ISP): (M+H) 909.7 (M+Na) 931.8.

Step 5

N-[4-({3-[(3beta)-cholest-5-en-3-yloxy]
propyl}amino)-4-oxobutanoyl]-L-phenylalanyl-N-
[4-({[(4-nitrophenoxy)carbonyl]oxy}methyl)phe-
nyl]-L-norleucinamide

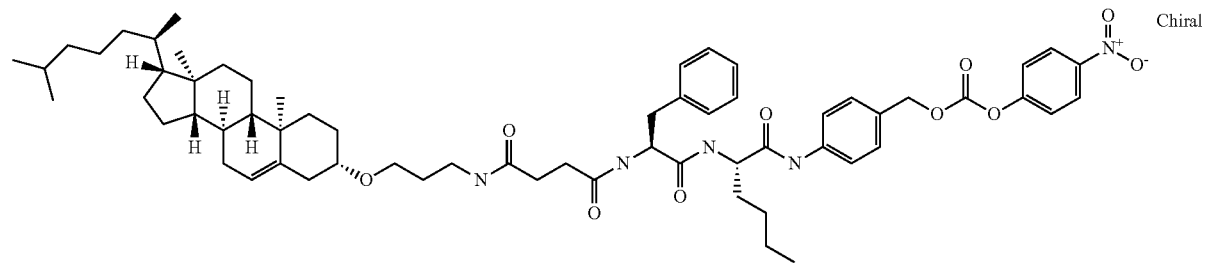

was prepared therewith in analogy to example 16 step 3. MS expected mass: 1073.6453, found mass 1073.642

Example 18

N-[4-({3-[(3beta)-cholest-5-en-3-yloxy]propyl}amino)-4-oxobutanoyl]-L-alanyl-N-[4-({[(4-nitrophenoxy)carbonyl]oxy}methyl)phenyl]glycinamide

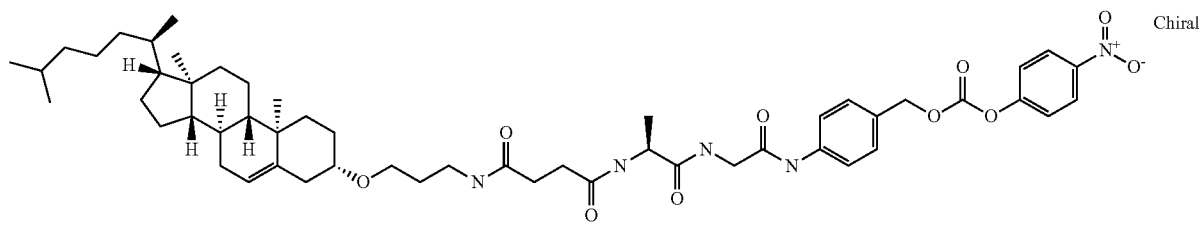

Step 1

Addition of FMOC-4-Aminobenzylalcohol to the 2-chlorotrityl resin

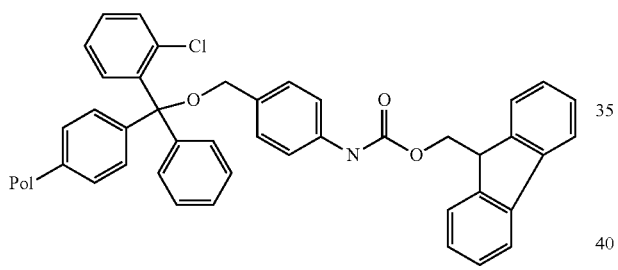

2-Chlorotrityl chloride resin (Novabiochem 01-64-0114, 100-200 mesh), 1% DVB (18 g, 21.6 mmol, Eq: 1.00) was swollen in DCM/DMF=1/1 (300 mL) for ten minutes. The resin was drained and a solution of FMOC-4-aminobenzyl alcohol (14.9 g, 43.2 mmol, Eq: 2) and pyridine (6.83 g, 6.99 ml, 86.4 mmol, Eq: 4) in DCM/DMF=1/1 (300 mL) was added. The mixture was shaken over night. The resin was drained and capped with a solution of 10% Hünig's Base in methanol (300 mL). The resin was washed with DMF and DCM and dried over night with HV to obtain 21.7 g resin. Determination of the load resulted in 0.41 mmoL/g.

Step 2

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-(2-(4-(hydroxymethyl)phenylamino)-2-oxoethylamino)-1-oxopropan-2-yl)succinamide

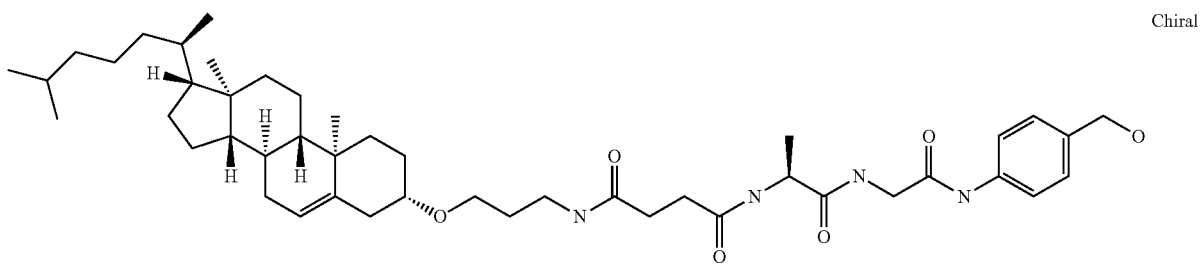

The resin from step 1(1 g, 410 μmol, Eq: 1.00) was pre-washed with DMF (2×) and treated with piperidine/DMF=1/4 (10 mL) for 5 and 10 minutes. The resin was washed alternately with DMF and IPA (3×10 mL). A solution of Fmoc-Gly-OH (488 mg, 1.64 mmol, Eq: 4), TPTU (487 mg, 1.64 mmol, Eq: 4) and Huenig's base (636 mg, 859 μl, 4.92 mmol, Eq: 12) in DMF (10 mL) was stirred for 5 minutes and then shaken with the resin for one hour. The resin was washed alternately with DMF and isopropyl alcohol (3×).

The following Fmoc cleavages and subsequent couplings of Fmoc-Ala-OH (511 mg, 1.64 mmol, Eq: 4) and N-{3-[(3S,8S,9S,10R,13R,14S,17R)-17-((R)-1,5-Dimethyl-hexyl)-10,13-dimethyl-2,3,4,7,8,9,10,11,12,13,14,15,16,17-tetradecahydro-1H-cyclopenta[a]phenanthren-3-yloxy]-propyl}-succinamic acid (example 1, step 2) (892 mg, 1.64 mmol, Eq: 4) were performed accordingly. The dried peptide resin was stirred for about 2×30 min in TFA 1%/DCM (2×20 mL). The reaction mixture was filtered and the resin was washed with DCM. The filtrates were pooled and the solvents evaporated under vacuum. The crude material was triturated with diethyl ether (2×). After purification by flash chromatography, the product (84 mg, 97.3 μmol) was obtained as a white solid. MS expected mass: 776.5452, found mass 776.5455

Step 3

The above prepared alcohol N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-(2-(4-(hydroxymethyl)phenylamino)-2-oxoethylamino)-1-oxopropan-2-yl)succinamide [RO5545270] (70 mg, 90.1 μmol, Eq: 1.00) and bis(4-nitrophenyl) carbonate (137 mg, 450 μmol, Eq: 5) under Argon at room temperature were dissolved in DMF (4 ml) and treated with Huenig's base (34.9 mg, 47.2 μl, 270 μmol, Eq: 3). and the mixture was allowed to react overnight. The solvent was removed in vacuo. The resulting solid was triturated with diethylether. The solid was collected by filtration and washed with diethyl ether. The product was dried in vacuo to obtain the title compound (84 mg, 80.2 μmol) as a light brown solid. MS expected mass: 941.5514, found mass 941.5518

Example 19

N-[4-({3-[(3beta)-cholest-5-en-3-yloxy]propyl}amino)-4-oxobutanoyl]-L-leucyl-N-[4-({[(4-nitrophenoxy)carbonyl]oxy}methyl)phenyl]-L-methioninamide

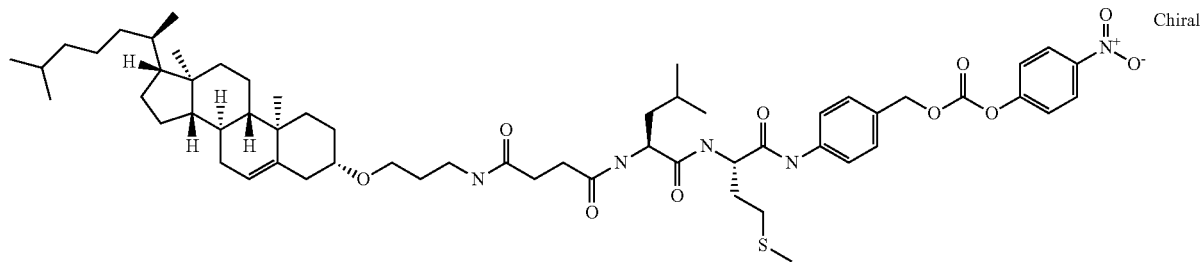

Step 1

Addition of FMOC-4-aminobenzylalcohol to the 2-chlorotrityl resin

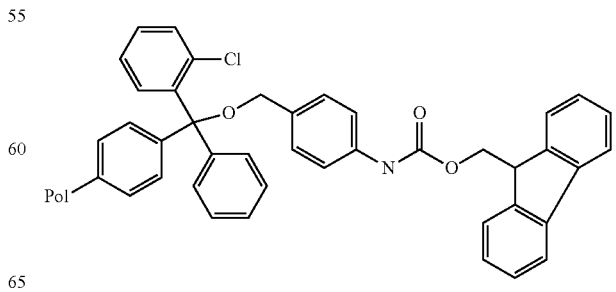

was prepared in analogy to example 18, step 1

Step 2

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-((S)-1-(4-(hydroxymethyl)phenylamino)-4-(methylthio)-1-oxobutan-2-ylamino)-4-methyl-1-oxopentan-2-yl)succinamide

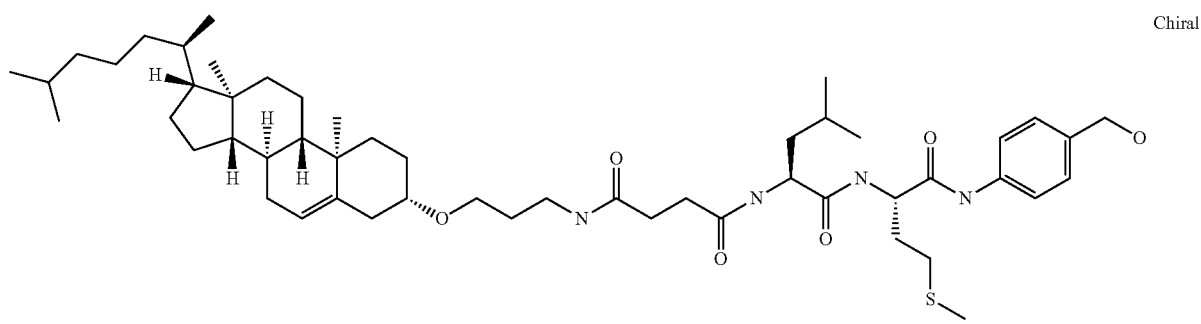

was prepared in analogy to example 18, step 2, using Fmoc-Met-OH (609 mg, 1.64 mmol, Eq: 4) and Fmoc-Leu-OH (580 mg, 1.64 mmol, Eq: 4) as amino acids. The product (208 mg, 210 μmol) was obtained as a light yellow solid. MS (ISP): (M+H) 893.6183

Step 3 was prepared in analogy to example 18, step 3. After purification on silica gel, the title compound (161 mg, 137 μmmol) was obtained as light brown solid. MS expected mass: 1057.6174, found mass 1057.6184

Example 20

N-[4-({3-[(3beta)-cholest-5-en-3-yloxy]propyl}amino)-4-oxobutanoyl]-L-leucyl-N~1~-[4-({[(4-nitrophenoxy)carbonyl]oxy}methyl)phenyl]-L-aspartamide

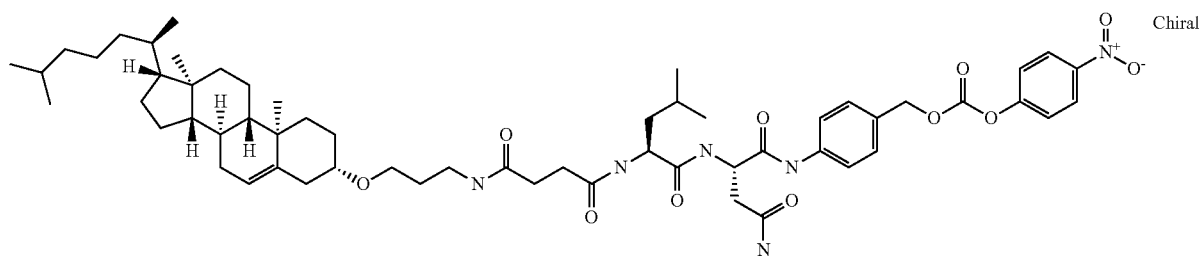

Step 1

Addition of FMOC-4-aminobenzylalcohol to the 2-chlorotrityl Resin

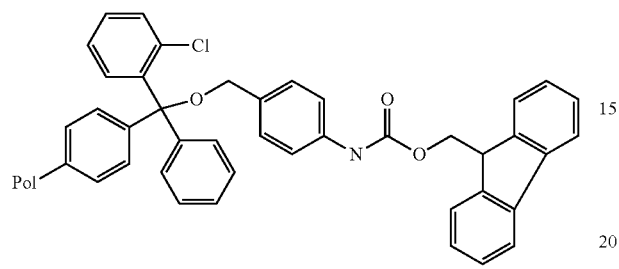

was performed in analogy to example 18, step 1

Step 2

(S)-2-((S)-2-(4-(3-((3S,8S,9S,10R,13R,14S,17R)-10, 13-dimethyl-17-((R)-6-methylheptan-2-yl)-2,3,4,7,8, 9,10,11,12,13,14,15,16,17-tetradecahydro-1H-cyclopenta[a]phenanthren-3-yloxy)propylamino)-4-oxobutanamido)-4-methylpentanamido)-N1-(4-(hydroxymethyl)phenyl)succinamide

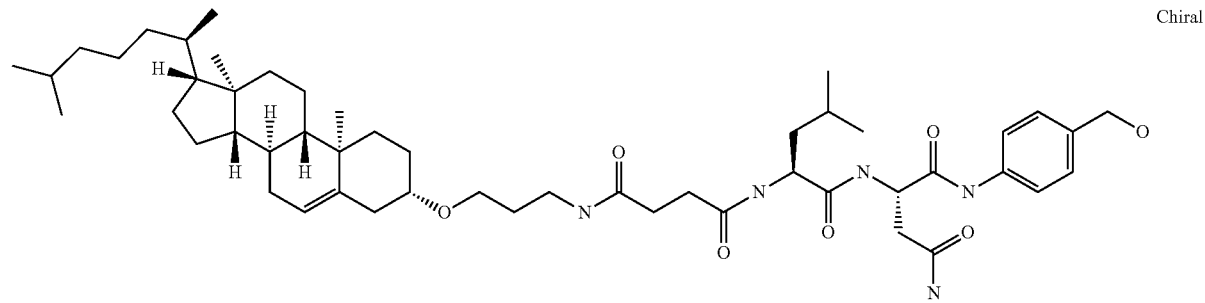

Was prepared in analogy to example 18, step 2, using Fmoc-Asn-OH (581 mg, 1.64 mmol, Eq: 4) and Fmoc-Leu-OH (580 mg, 1.64 mmol, Eq: 4) as amino acids. The product (87 mg, 89.4 μmmol) was obtained as a light yellow solid. MS expected mass: 875.6136, found mass 875.6133

Step 3

The titled compound was prepared in analogy to example 18, step 3. After purification on silica gel (87 mg, 89.4 μmmol) the title compound was obtained as light brown solid. MS expected mass: 1040.6198, found mass 1040.6188.

Example 21

N-[4-({3-[(3beta)-cholest-5-en-3-yloxy]propyl}amino)-4-oxobutanoyl]-L-alanyl-N~1~-[4-({[(4-nitrophenoxy)carbonyl]oxy}methyl)phenyl]-L-aspartamide

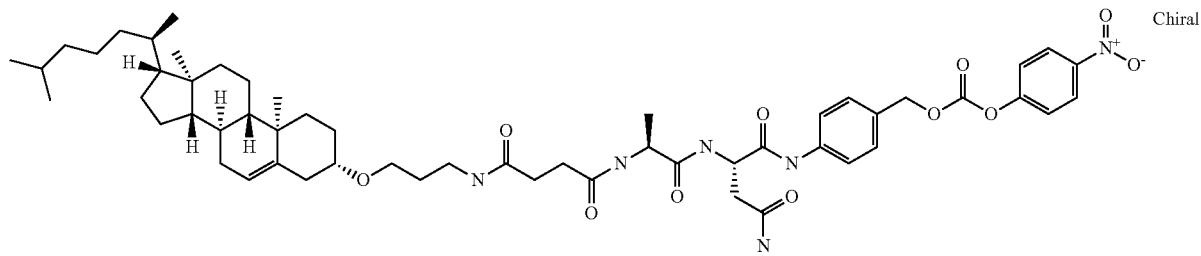

Step 1

Addition of FMOC-4-aminobenzylalcohol to the 2-chlorotrityl Resin

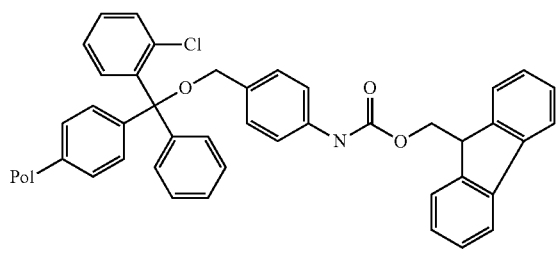

was performed in analogy to example 18, step 1

Step 2

(S)-2-((S)-2-(4-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propylamino)-4-oxobutanamido)propanamido)-N1-(4-(hydroxymethyl)phenyl)succinamide Was prepared in analogy to example 18, step 2, using Fmoc-Asn-OH (581 mg, 1.64 mmol, Eq: 4) and Fmoc-Ala-OH (511 mg, 1.64 mmol, Eq: 4) as amino acids. The product (140 mg, 159 mmol) was obtained as light yellow solid. MS (ISP): (M+H) 834.8 (M+Na) 856.7

Step 3

The title compound was prepared in analogy to example 18, step 3. After purification on silica gel (169 mg, 152 μmmol) it was obtained as light brown solid. MS expected mass: 998.5729, found mass 998.5739

Example 22

N~2~-[4-({3-[(3beta)-cholest-5-en-3-yloxy]propyl}amino)-4-oxobutanoyl]-L-asparaginyl-N-[4-({[(4-nitrophenoxy)carbonyl]oxy}methyl)phenyl]glycinamide

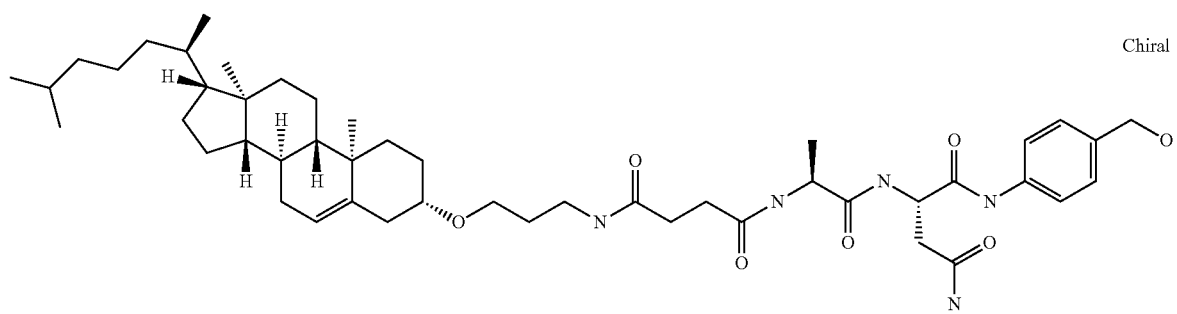

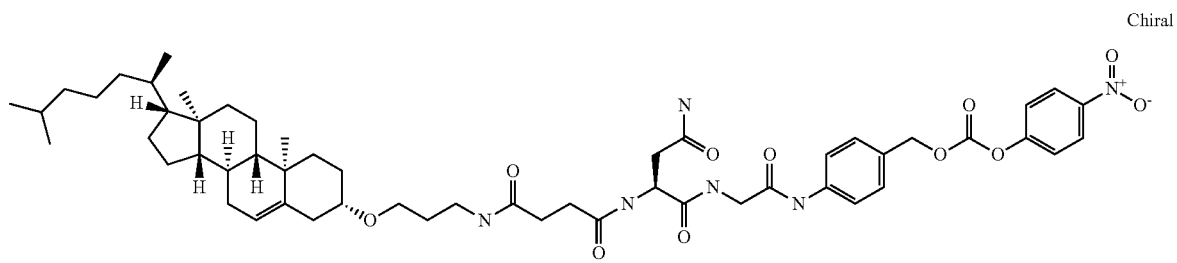

Step 1

Addition of FMOC-4-Aminobenzylalcohol to the 2-chlorotrityl Resin

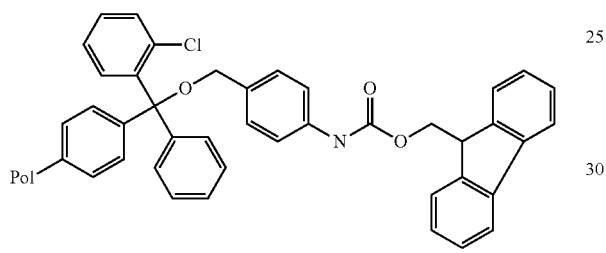

Was performed in analogy to example 18, step 1

Step 2

(S)-2-(4-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propylamino)-4-oxobutanamido)-N1-(2-(4-(hydroxymethyl)phenylamino)-2-oxoethyl)succinamide

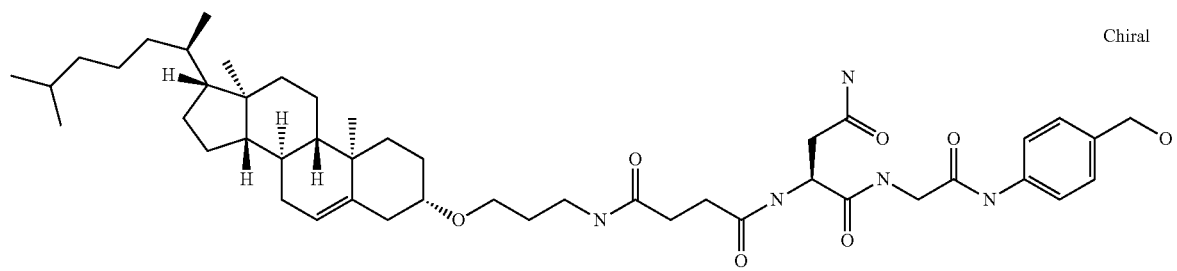

Was prepared in analogy to example 18, step 2, using Fmoc-Gly-OH (488 mg, 1.64 mmol, Eq: 4) and Fmoc-Asn-OH (581 mg, 1.64 mmol, Eq: 4) as amino acids. The product (140 mg, 162 µmol) was obtained as white solid. MS expected mass: 819.551, found mass 819.5503

Step 3

The title compound was obtained in analogy to example 18, step 3 (176 mg, 161 μmol) as light brown solid. MS expected mass: 984.5572, found mass 984.5489

Example 23

N-[4-({3-[(3beta)-cholest-5-en-3-yloxy]propyl}amino)-4-oxobutanoyl]-L-phenylalanyl-N-[4-({[(4-nitrophenoxy)carbonyl]oxy}methyl)phenyl]glycinamide

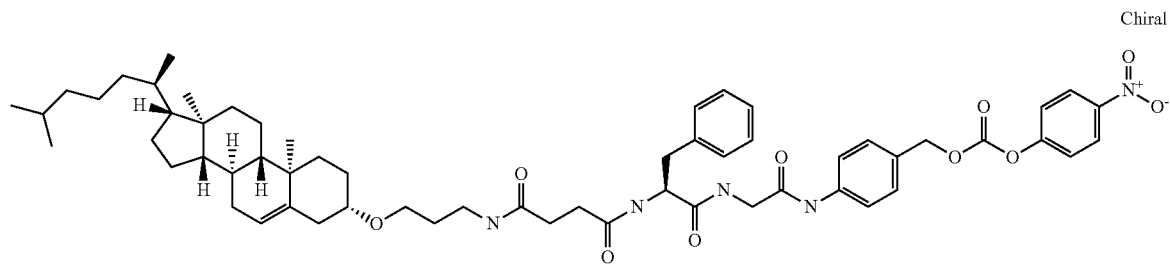

Step 1

Addition of FMOC-4-aminobenzylalcohol to the 2-chlorotrityl Resin

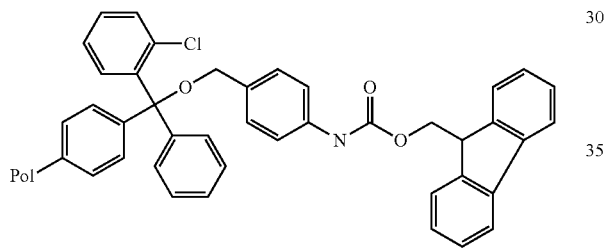

Was performed in analogy to example 18, step 1

Step 2

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-(2-(4-(hydroxymethyl)phenylamino)-2-oxoethylamino)-1-oxo-3-phenylpropan-2-yl)succinamide

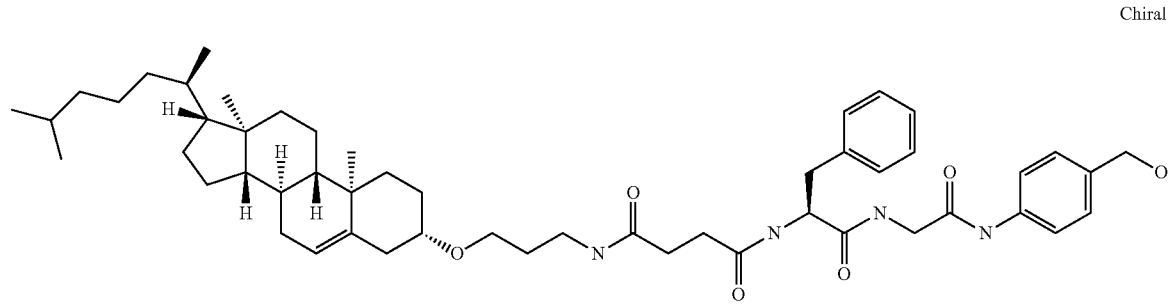

Was prepared in analogy to example 18, step 2, using Fmoc-Gly-OH (488 mg, 1.64 mmol, Eq: 4) and Fmoc-Phe-OH (635 mg, 1.64 mmol, Eq: 4) as amino acids. The product (259 mg, 288 μmol) was obtained as white solid. MS expected mass: 852.5765, found mass 852.5754

Step 3

The title compound was obtained in analogy to example 18, step 3. (280 mg, 247 μmol) as light brown solid. MS expected mass: 1017.5827, found mass 1017.5775

Example 24

N-[4-({3-[(3beta)-cholest-5-en-3-yloxy]propyl}amino)-4-oxobutanoyl]-L-leucyl-N-[4-({[(4-nitrophenoxy)carbonyl]oxy}methyl)phenyl]glycinamide

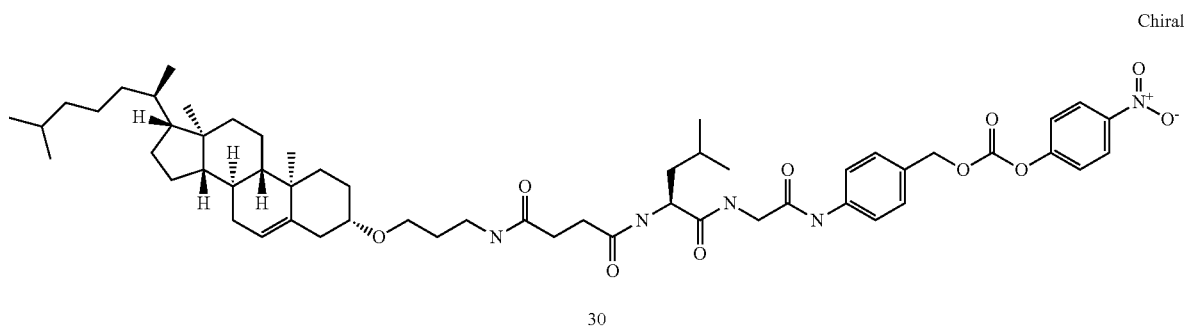

Step 1

Addition of FMOC-4-aminobenzylalcohol to the 2-chlorotrityl Resin

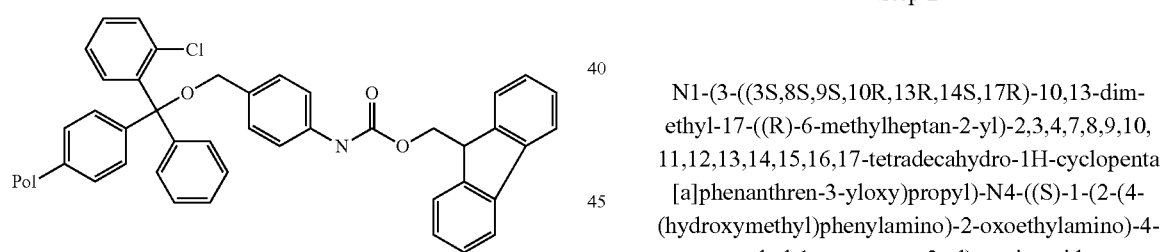

Was performed in analogy to example 18, step 1

Step 2

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-(2-(4-(hydroxymethyl)phenylamino)-2-oxoethylamino)-4-methyl-1-oxopentan-2-yl)succinamide

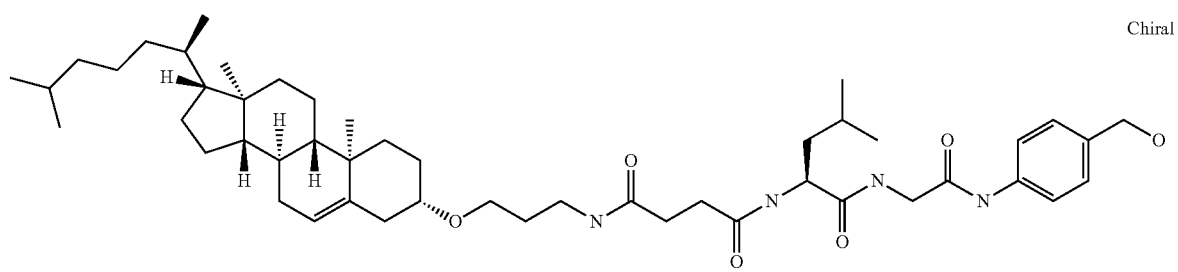

Was prepared in analogy to example 18, step 2, using Fmoc-Gly-OH (488 mg, 1.64 mmol, Eq: 4) and Fmoc-Leu-OH (580 mg, 1.64 mmol, Eq: 4) as amino acids. The product (240 mg, 278 μmmol) was obtained as a light yellow solid. MS expected mass: 818.5921, found mass 818.5921

Step 3

The title compound was prepared in analogy to example 18, step 3. After purification on silica gel, it (194 mg, 177 μmol) was obtained as light yellow solid. MS expected mass: 983.5983 found mass 983.6004

Example 25

N-[4-({3-[(3beta)-cholest-5-en-3-yloxy]propyl}amino)-4-oxobutanoyl]-L-leucyl-N-[4-({[(4-nitrophenoxy)carbonyl]oxy}methyl)phenyl]-L-phenylalaninamide

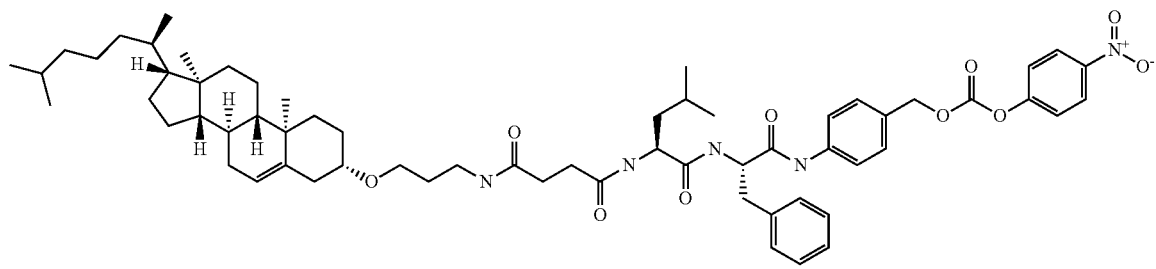

Step 1

Addition of FMOC-4-aminobenzylalcohol to the 2-chlorotrityl Resin

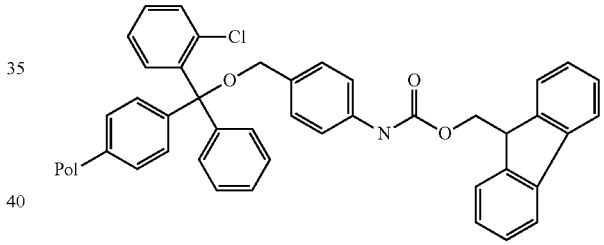

Was performed in analogy to example 18, step 1

Step 2

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-((S)-1-(4-(hydroxymethyl)phenylamino)-1-oxo-3-phenylpropan-2-ylamino)-4-methyl-1-oxopentan-2-yl)succinamide

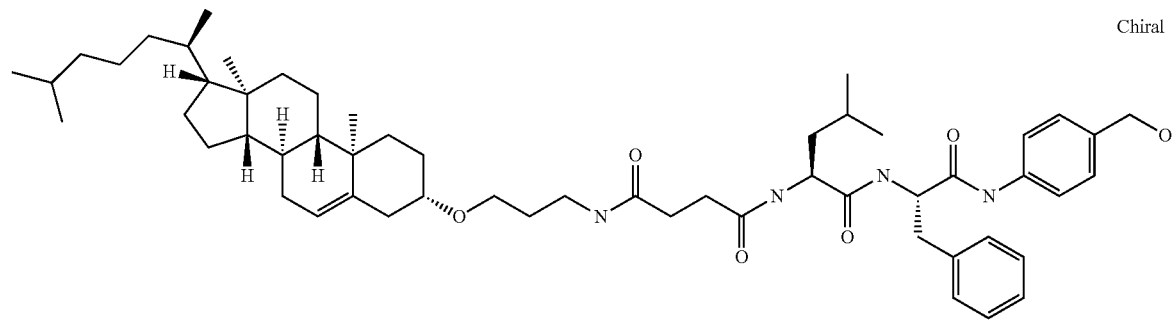

Was prepared in analogy to example 18, step 2, using Fmoc-Phe-OH (635 mg, 1.64 mmol, Eq: 4) and Fmoc-Leu-OH (580 mg, 1.64 mmol, Eq: 4) as amino acids. The product (153 mg, 151 μmmol) was obtained as light yellow solid. MS expected mass: 908.6391 found mass 908.637

Step 3

The title compound was prepared in analogy to example 18, step 3. After purification on silica gel, it (117 mg, 98 μmmol) was obtained as white solid. MS expected mass: 1073.6453 found mass 1073.646

Example 26

N-[4-({3-[(3beta)-cholest-5-en-3-yloxy]propyl}amino)-4-oxobutanoyl]-L-phenylalanyl-N-[4-({[(4-nitrophenoxy)carbonyl]oxy}methyl)phenyl]-L-phenylalaninamide

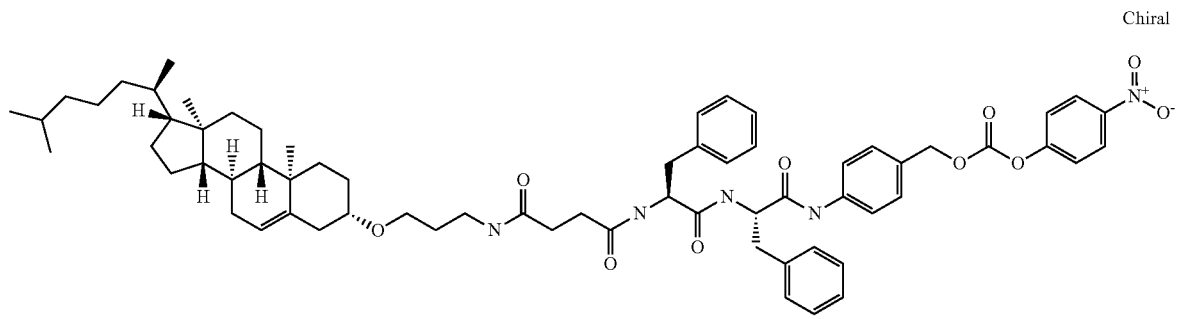

Step 1

Addition of FMOC-4-aminobenzylalcohol to the 2-chlorotrityl Resin

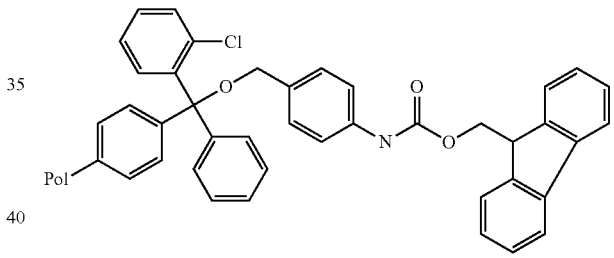

Was performed in analogy to example 18, step 1

Step 2

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-((S)-1-(4-(hydroxymethyl)phenylamino)-1-oxo-3-phenylpropan-2-ylamino)-1-oxo-3-phenylpropan-2-yl)succinamide

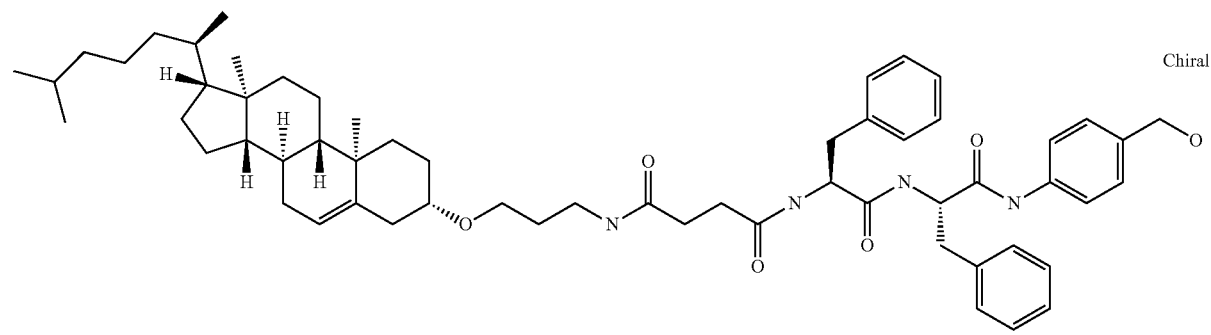

Was prepared in analogy to example 18, step 2, with Fmoc-Phe-OH (635 mg, 1.64 mmol, Eq: 4) as amino acid. The product (240 mg, 204 µmol) was obtained as light yellow solid. MS expected mass: 942.6234 found mass 942.6218

Step 3

The title compound was prepared analogously to example 18, step 3. After purification on silica gel, it (190 mg, 154 µmmol) was obtained as white solid. MS expected mass: 1107.6296 found mass 1107.6287.

Example 27

N-[4-({3-[(3beta)-cholest-5-en-3-yloxy]propyl}amino)-4-oxobutanoyl]-L-leucyl-N-[4-({[(4-nitrophenoxy)carbonyl]oxy}methyl)phenyl]-L-leucinamide

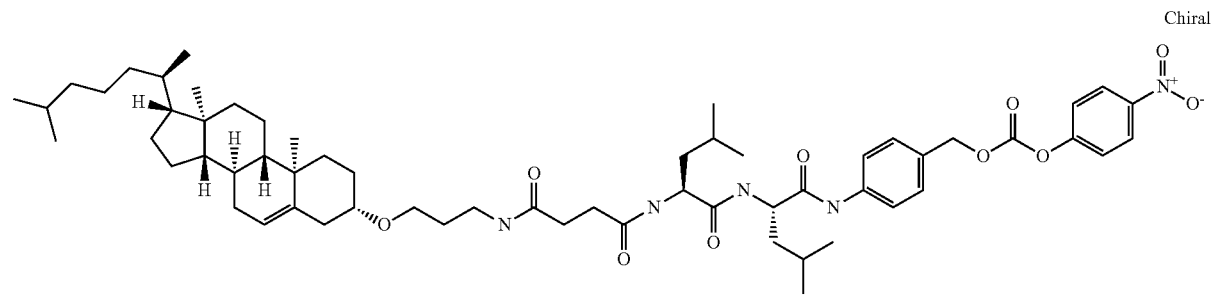

Step 1

Addition of FMOC-4-aminobenzylalcohol to the 2-chlorotrityl Resin

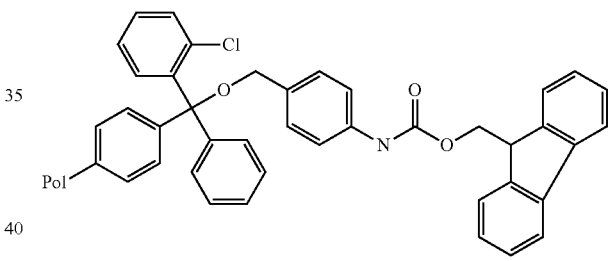

Was performed analogously to example 18, step 1

Step 2

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-((S)-1-(4-(hydroxymethyl)phenylamino)-4-methyl-1-oxopentan-2-ylamino)-4-methyl-1-oxopentan-2-yl)succinamide

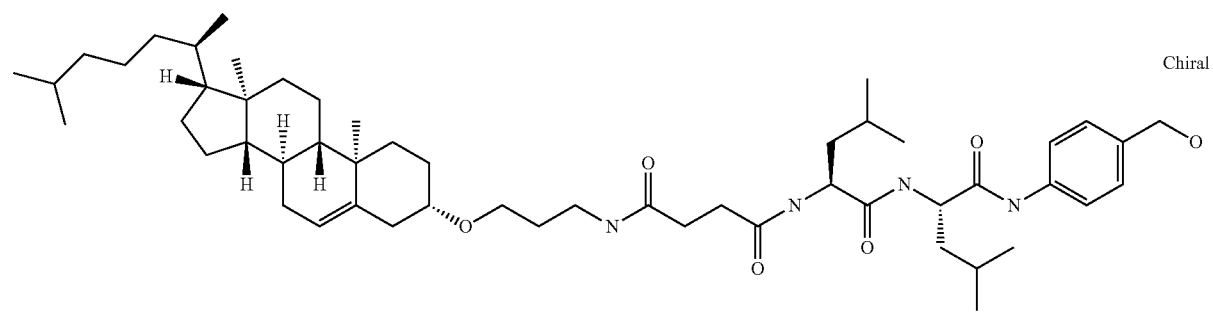

Was prepared in analogy to example 18, step 2, with Fmoc-Leu-OH (1.59 g, 4.5 mmol, Eq: 3) as amino acid. The product (254 mg, 284 μmol) was obtained as white solid. MS expected mass: 874.6547 found mass 874.6527

Step 3

The title compound was prepared in analogy to example 18, step 3. After purification on silica gel it was obtained as white solid (178 mg, 168 μmmol). MS expected mass: 1039.6609 found mass 1039.6588

Example 28

N-[4-({3-[(3beta)-cholest-5-en-3-yloxy]propyl}amino)-4-oxobutanoyl]-L-alanyl-N-[4-({[(4-nitrophenoxy)carbonyl]oxy}methyl)phenyl]-L-alaninamide

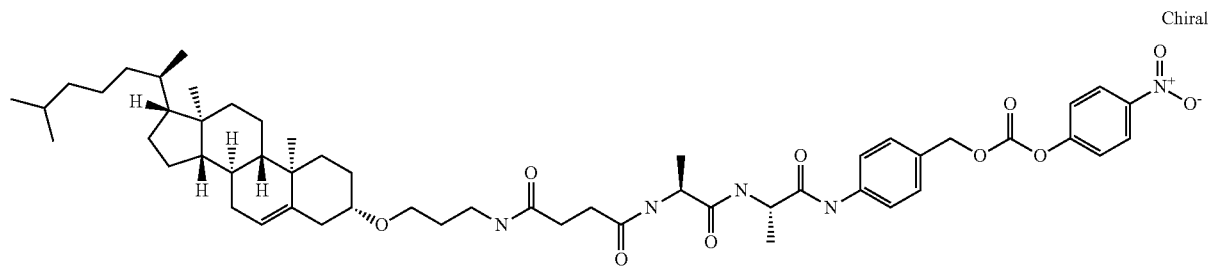

Step 1

{(S)-1-[(S)-1-(4-Hydroxymethyl-phenylcarbamoyl)-ethylcarbamoyl]-ethyl}-carbamic acid 9H-fluoren-9-ylmethyl ester

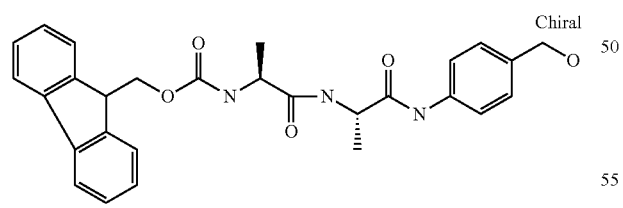

A solution of Fmoc-Ala-Ala-OH (1 g, 2.61 mmol, Eq: 1.00) and (4-aminophenyl)methanol (483 mg, 3.92 mmol, Eq: 1.5) in THF (20 ml) was treated with EEDQ (970 mg, 3.92 mmol, Eq: 1.5). The solution was stirred over night at room temperature. The mixture was diluted with 10% 2-propanol/ethyl acetate (100 mL) and the solution was washed with KHSO4 5%/K2SO4 10% (2×), water (1×) and brine (1×), dried over MgSO4 and evaporated in vacuo. The residue was sonicated in diethyl ether for several minutes and the solid was collected by filtration to obtain the product (1.27 g, 1.2 mmol) as light brown solid. MS (ISP): (M+H) 488.3.

Step 2

(S)-2-Amino-N—[(S)-1-(4-hydroxymethyl-phenyl-carbamoyl)-ethyl]-propionamide

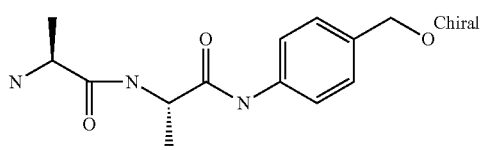 [SMILES: C[C@H](N)C(=O)N[C@@H](C)C(=O)Nc1ccc(CO)cc1]

The compound was prepared in analogy to example 1 step c to obtain the product (245 mg, 877 μmol) as light yellow solid. MS (ISP): (M+H) 266.3, (M+Na) 288.2 (2M+H) 531.3.

Step 3

N1-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy)propyl)-N4-((S)-1-((S)-1-(4-(hydroxymethyl)phenylamino)-1-oxopropan-2-ylamino)-1-oxopropan-2-yl)succinamide

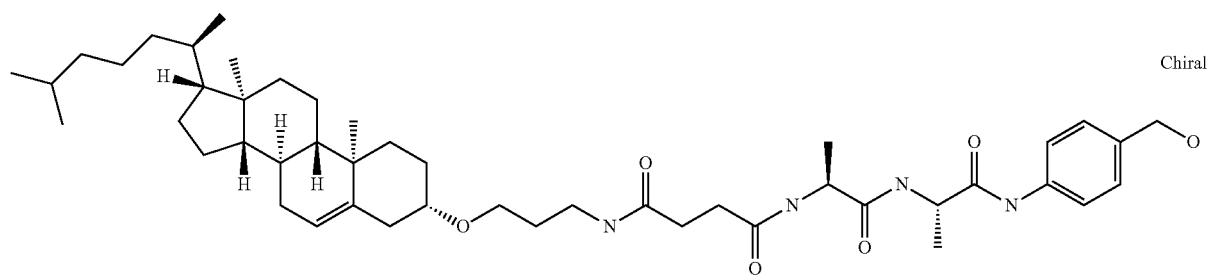

The compound was prepared in analogy to example 16 step 2 (165 mg, 198 μmmol) as light brown solid. MS expected mass: 790.5608, found mass 790.5587.

Step 4

The title compound was prepared in analogy to example 18, step 3. After purification on silica gel it was obtained as white solid (99 mg, 98.4 μmmol).

MS expected mass: 955.567, found mass 955.5651

Example 29

N-[4-({3-[(3beta)-cholest-5-en-3-yloxy]propyl}amino)-4-oxobutanoyl]-L-isoleucyl-N~1~-[4-({[(4-nitrophenoxy)carbonyl]oxy}methyl)phenyl]-L-aspartamide

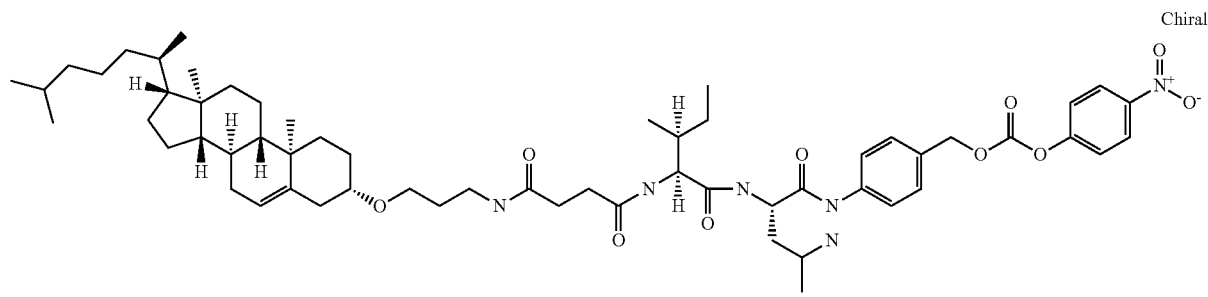

Step 1

(S)-2-[(2S,3S)-2-(9H-Fluoren-9-ylmethoxycarbonylamino)-3-methyl-pentanoylamino]-succinamic acid

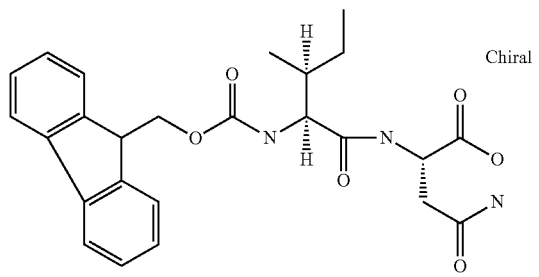 [SMILES: CC[C@H](C)[C@H](NC(=O)OCC1c2ccccc2-c2ccccc21)C(=O)N[C@@H](CC(N)=O)C(=O)O]

2-Chlorotrityl chloride resin (5 g, 7.5 mmol, Eq: 1.00) was swollen in DCM and then treated with a solution of Fmoc-Asn(Trt)-OH (8.95 g, 15.0 mmol, Eq: 2) and Huenig's base (3.88 g, 5.1 ml, 30.0 mmol, Eq: 4) in DCM overnight. The resin was washed with DCM and capped with a solution of 10% Huenig's base in methanol. Coupling of Fmoc-Ile-OH (5.3 g, 15.0 mmol, Eq: 2) with TPTU (4.46 g, 15.0 mmol, Eq: 2) and Huenig's base (3.88 g, 5.1 ml, 30.0 mmol, Eq: 4) according to standard solid phase peptide synthesis. The product was cleaved from the resin with a cocktail of TFA/Water/triisopropylsilane (95/2.5/2.5 v/v/v) for two hours at room temperature. The resin was filtered and the filtrate was concentrated under reduced pressure to a small volume. After trituration with diethyl ether, the product was filtered and dried in vacuum to obtain the product (2.85 g, 5.79 mmol) as white solid. MS expected mass: 467.2056, found mass 467.2056

Step 2

{(1S,2S)-1-[2-Carbamoyl-1-((S)-4-hydroxymethyl-phenylcarbamoyl)-ethylcarbamoyl]-2-methyl-butyl}-carbamic acid 9H-fluoren-9-ylmethyl ester

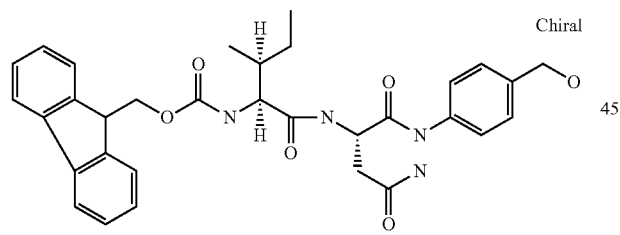

The compound was prepared in analogy to example 28 step 1 (620 mg, 336 µmmol) as light yellow solid.

Step 3

(S)-2-((2S,3S)-2-Amino-3-methyl-pentanoylamino)-N*1*-(4-hydroxymethyl-phenyl)-succinamide

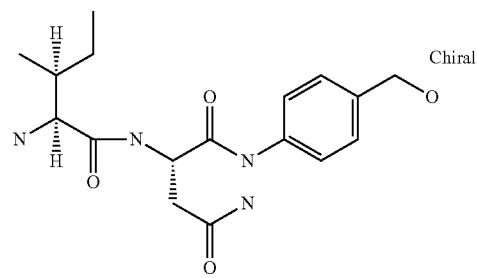 [SMILES: CC[C@H](C)[C@H](N)C(=O)N[C@@H](CC(N)=O)C(=O)Nc1ccc(CO)cc1]

The compound was prepared in analogy to example 1 step c (100 mg, 228 µmol) as light yellow solid.

Step 4

(S)-2-((2S,3 S)-2-(4-(3-((3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yloxy) propylamino)-4-oxobutanamido)-3-methylpentanamido)-N1-(4-(hydroxymethyl)phenyl) succinamide

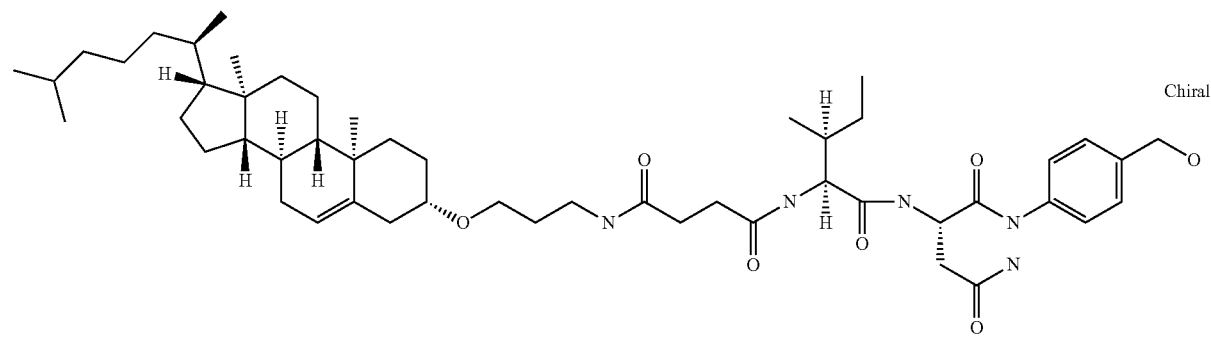

The compound was prepared in analogy to example 16 step 2 (89 mg, 91.4 μmmol) as light yellow solid.

Step 5

The compound from the previous step was reacted to the title compound analogously to example 18, step 3. After purification on silica gel, it (42 mg, 36.3 μmmol) was obtained as a light brown solid. MS expected mass: 1040.6198, found mass 1040.6177

Example 30

N-[4-({3-[(3beta)-cholest-5-en-3-yloxy]propyl}amino)-4-oxobutanoyl]-L-phenylalanyl-N~6~-[(4-methoxyphenyl)(diphenyl)methyl]-N-[4-({[(4-nitrophenoxy)carbonyl]oxy}methyl)phenyl]-D-lysinamide

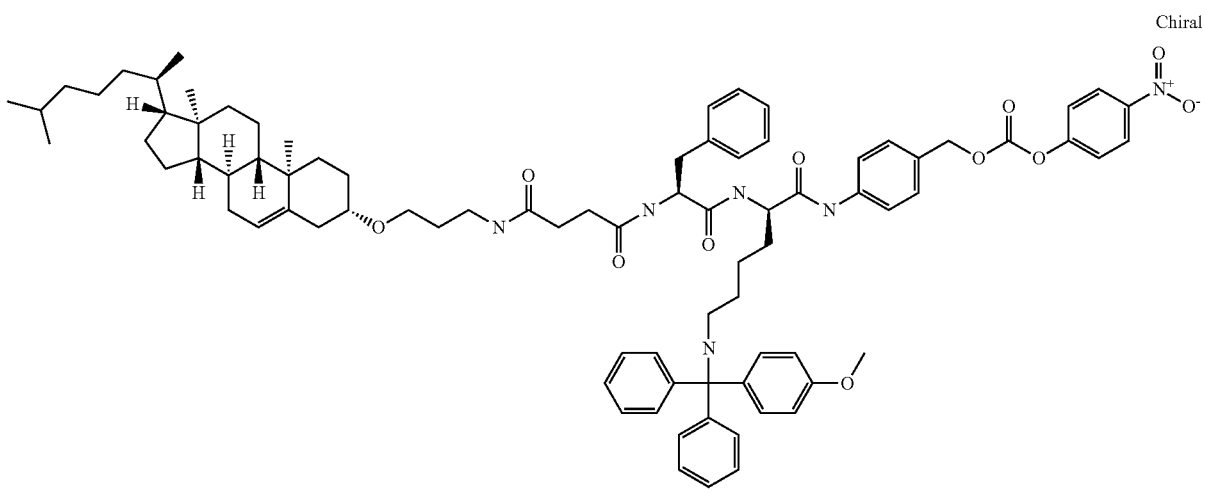

The compound was prepared in analogy to example 16 step 1, starting with Fmoc-D-Lys(Boc)-OH, (158 mg, 116 μmmol) as light brown solid. MS (ISP): (M+H) 1362.8 (M+Na) 1383.8.

Example 31

N-{15-[(3beta)-cholest-5-en-3-yloxy]-4,15-dioxo-8,11-dioxa-5,14-diazapentadecan-1-oyl}-L-phenylalanyl-N-~6~-[(4-methoxyphenyl)(diphenyl)methyl]-N-[4-({[(4-nitrophenoxy)carbonyl]oxy}methyl)phenyl]-L-lysinamide

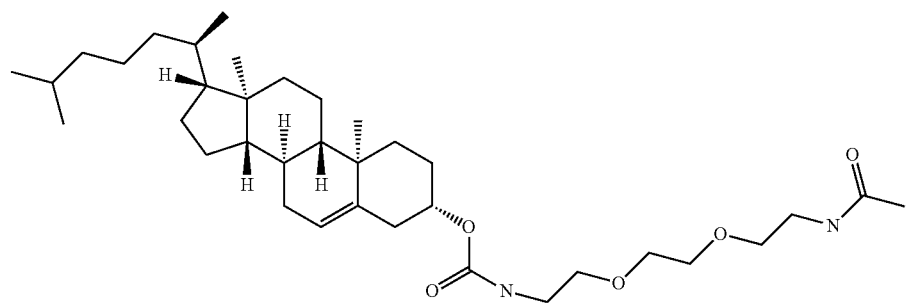

-continued

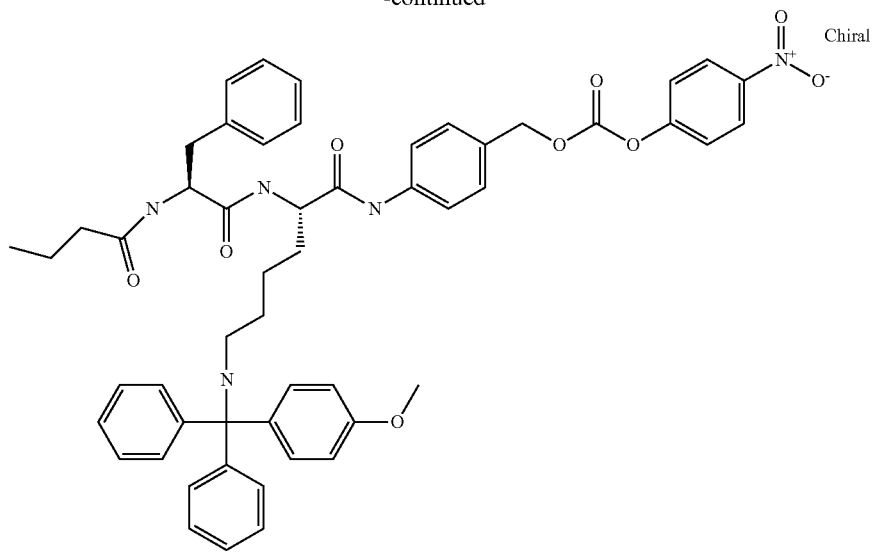

The title compound was prepared analogous to example 16 using a cholesterol-oligo-PEG derivative in step 2 of the synthesis. MS (ISP): (M+H) 1479.8.

The necessary cholesterol-PEG intermediate N-[2-(2-{2-[(3S,8S,9S,10R,13R,14S,17R)-17-((R)-1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-ethoxy}-ethoxy)-ethyl]-succinamic acid for step 2 was prepared as follows:

Step a

{2-[2-(2-Amino-ethoxy)-ethoxy]-ethyl}-carbamic acid (3S,8S,9S,10R,13R,14S,17R)-17-((R)-1,5-dimethyl-hexyl)-10,13-dimethyl-2,3,4,7,8,9,10,11,12,13,14,15,16,17-tetradecahydro-1H-cyclopenta[a]phenanthren-3-yl ester

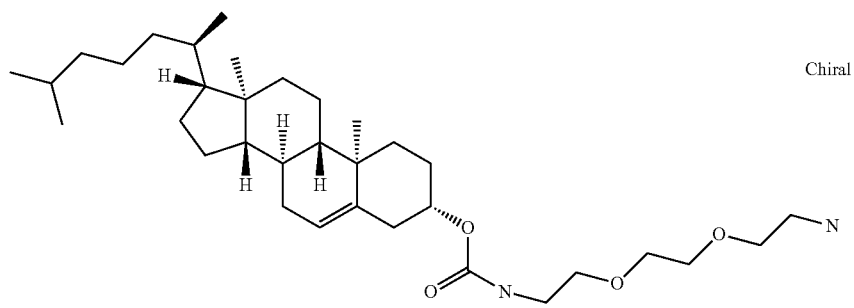

A solution of cholesteryl chloroformate (1 g, 2.23 mmol) in 25 mL dichloromethane was added dropwise under stirring to a solution of 2,2'-(ethylenedioxy)bis-(ethylamine) (495 mg, 3.34 mmol) in 75 mL dichloromethane. The reaction was stirred overnight at room temperature. The reaction was diluted with dichloromethane and extracted with water. The organic extract was dried over anhydrous MgSO4 dihydrate, filtered and evaporated. After purification on amino-modified silica gel (eluent: MeCl$_2$->MeCl$_2$/MeOH=975:25 v/v) the product (615 mg) was obtained as a white, waxy solid.

MS (ISP): (M+H) 561.5

Step b

N-[2-(2-{2-[(3S,8S,9S,10R,13R,14S,17R)-17-((R)-1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-ethoxy}-ethoxy)-ethyl]-succinamic acid

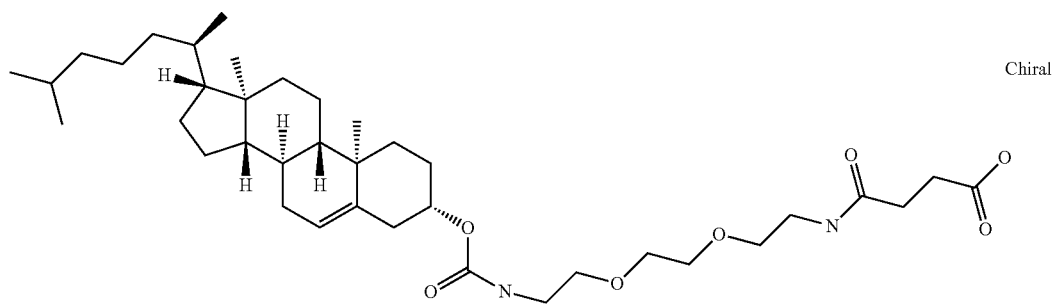

The amine from step a (480 mg, 0.856 mmol) and triethylamine (0.13 mL, 0.94 mmol) were dissolved in 5 mL dichloromethane. After adding succinic anhydride (90 mg, 0.9 mmol) the solution was stirred overnight at room temperature. TLC check showed still some starting material. More succinic anhydride (20 mg, 0.2 mmol) was added. After stirring the reaction for another 3 hours at room temperature, it was diluted with dichloromethane and washed with a 5% KHSO$_4$/10% K$_2$SO$_4$ mixture. The organic extract was dried over anhydrous MgSO$_4$-dihydrate, filtered and evaporated in vacuo to obtain the desired acid (490 mg, 0.667 mmol). MS (ISP): (M+H) 661.5

Example 32

N-{30-[(3beta)-cholest-5-en-3-yloxy]-4,30-dioxo-8,11,14,17,20,23,26-heptaoxa-5,29-diazatriacontan-1-oyl}-L-phenylalanyl-N-~6~-[(4-methoxyphenyl)(diphenyl)methyl]-N-[4-({[(4-nitrophenoxy)carbonyl]oxy}methyl)phenyl]-L-lysinamide

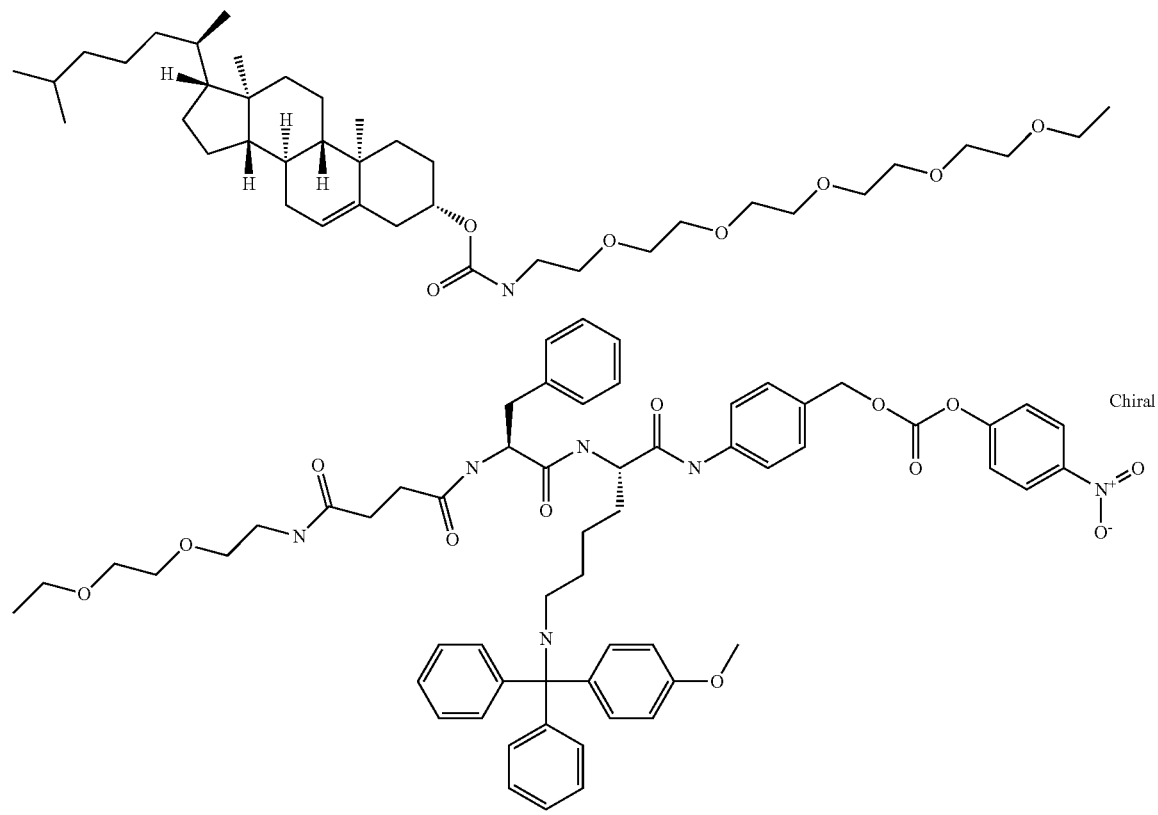

The title compound was prepared analogous to example 16 using a cholesterol -PEG derivative in step 2 of the synthesis. MS (ISP): (M+H) 1699.9

The necessary cholesterol-PEG intermediate 1-[(3beta)-cholest-5-en-3-yloxy]-1,27-dioxo-5,8,11,14,17,20,23-heptaoxa-2,26-diazatriacontan-30-oic acid for step 2 was prepared as follows:

Step a tert-butyl[25-({(3S,8S,9S,10R,13R,14S,17R)-10,13-dimethyl-17-[(2R)-6-methylheptan-2-yl]-2,3,4,7,8,9,10,11,12,13,14,15,16,17-tetradecahydro-1H-cyclopenta[a]phenanthren-3-yl}oxy)-25-oxo-3,6,9,12,15,18,21-heptaoxa-24-azapentacos-1-yl]carbamate

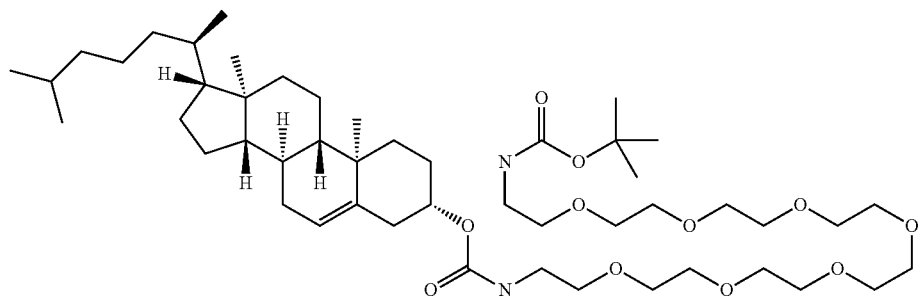

Cholesteryl chloroformate (476 mg, 1.06 mmol) and triethylamine (155 uL, 1.113 mmol) were dissolved in 5 mL dichloromethane. Then a solution of alpha-amino-omega-boc-amino-octa(ethylene glycol) (497 mg, 1.06 mmol) dissolved in 1 mL dichloromethane was added. The solution was stirred over night at room temperature and diluted with dichloromethane and extracted with a $KHSO_4$ 5%/$K_2SO_4$ 10% aqueous mixture. The organic extract was dried over anhydrous $MgSO_4$, filtered and evaporated in vacuo. After purification on silica gel (eluent: $MeCl_2$/MeOH= 975:25->95:5 v/v) the product (530 mg, 0.571 mmol) was obtained as a colorless oil. MS (ISP): (M+$NH_4$) 898.7

Step b

1-[(3beta)-cholest-5-en-3-yloxy]-1,27-dioxo-5,8,11,14,17,20,23-heptaoxa-2,26-diazatriacontan-30-oic acid

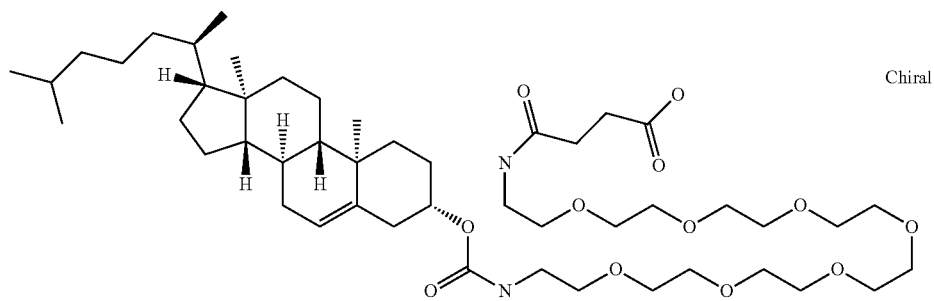

The previous Boc derivative (450 mg, 0.511 mmol) was dissolved in HCl 4M in dioxane (10.2 mL, 40.9 mmol). The solution was stirred at room temperature for 40 min. The solvent was removed in vacuo and the remaining white solid was dissolved in 5 mL dichloromethane and treated with triethylamine (32 uL, 0.229 mmol) and succinic anhydride (11.5 mg, 0.114 mmol) overnight. More succinic anhydride (11 mg, 0.11 mmol, 0.2 equiv.) was added and after 60 min the reaction was diluted with dichloromethane and washed with KHSO₄ 5%/K₂SO₄ 10% buffer. The organic extract was dried over MgSO₄ anhydrous, filtered and evaporated to obtain 390 mg of the desired product. MS (ISP): (M+H) 881.7

Example 33

N-{66-[(3beta)-cholest-5-en-3-yloxy]-4,66-dioxo-8,11,14,17,20,23,26,29,32,35,38,41,44,47,50,53,56,59,62-nonadecaoxa-5,65-diazahexahexacontan-1-oyl}-L-phenylalanyl-N-~6~-[(4-methoxyphenyl)(diphenyl)methyl]-N-[4-({[(4-nitrophenoxy)carbonyl]oxy}methyl)phenyl]-L-lysinamide

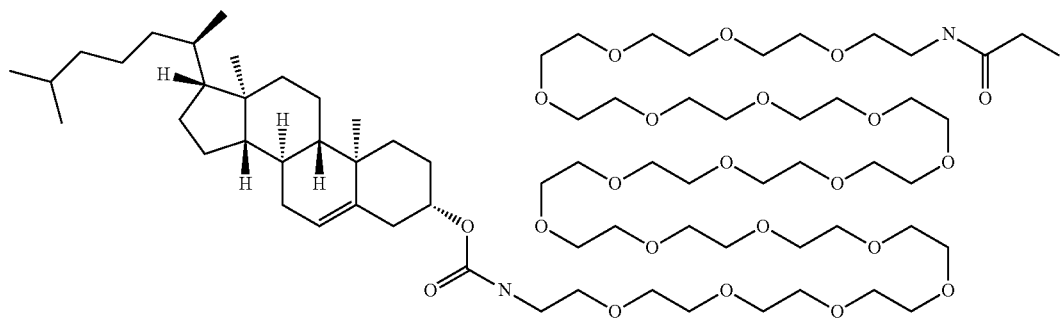

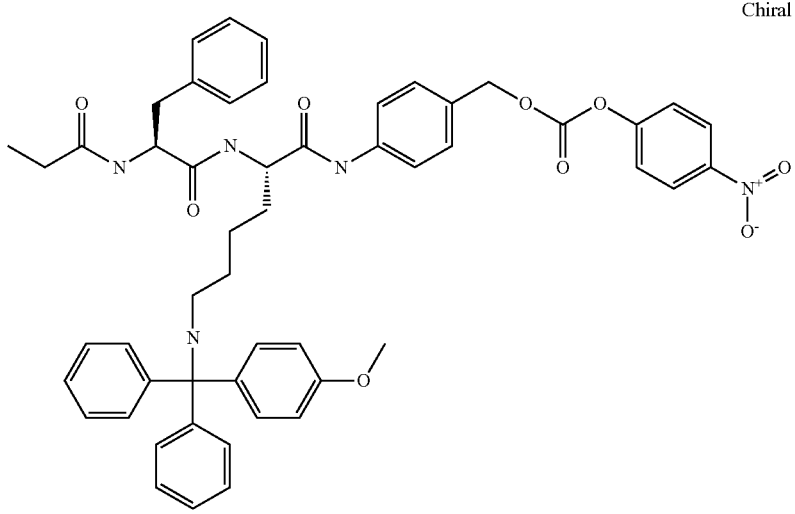

The title compound was prepared analogous to example 16 using a cholesterol-1-PEG derivative in step 2 of the synthesis. MS (ISP): (M+H) 2228.1

The necessary cholesterol-PEG intermediate 1-[(3beta)-cholest-5-en-3-yloxy]-1,63-dioxo-5,8,11,14,17,20,23,26,29,32,35,38,41,44,47,50,53,56,59-nonadecaoxa-2,62-diaza-hexahexacontan-66-oic acid for step 2 was prepared as follows:

Step a (3beta)-cholest-5-en-3-yl (59-amino-3,6,9,12,15,18,21,24,27,30,33,36,39,42,45,48,51,54,57 nonadeca-oxanonapentacont-1-yl)carbamate

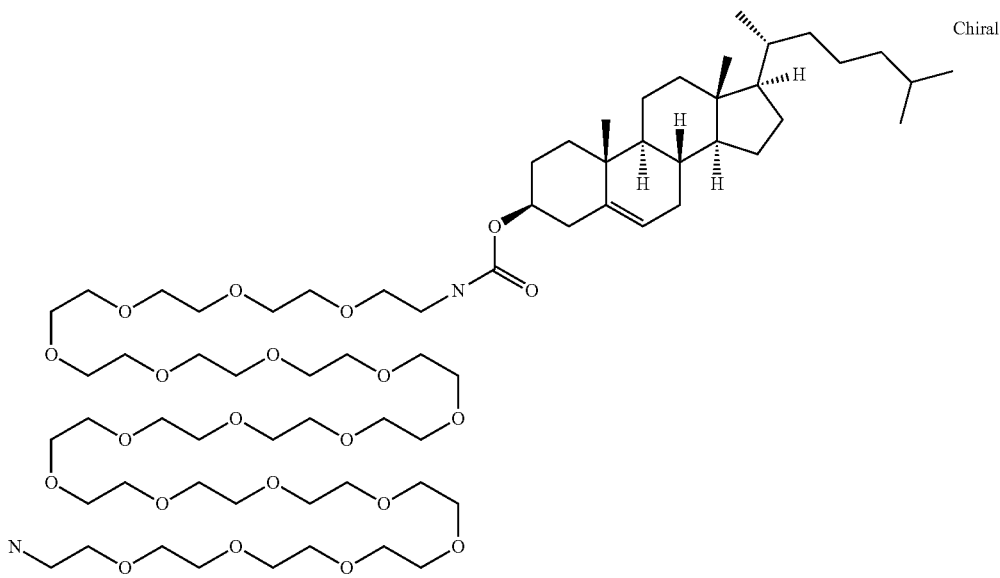

Alpha, omega-bis-amino 20(ethylene glycol) (538 mg, 0.6 mmol) and triethylamine (92 uL, 0.66 mmol) were dissolved in 15 mL dry dichloromethane. A solution of cholesteryl chloroformate (270 mg, 0.6 mmol) in 2 mL dry dichloromethane was added dropwise at room temperature. The solution was stirred overnight, then concentrated in vacuo to a small volume and purified directly on silica gel (eluent: MeCl2/MeOH=95:5->9:4->4:1 v/v) to obtain the product (350 mg, 0.254 mmol) as a waxy solid. MS (ISP): (M+H) 1309.9

Step b

1-[(3beta)-cholest-5-en-3-yloxy]-1,63-dioxo-5,8,11,
14,17,20,23,26,29,32,35,38,41,44,47,50,53,56,59-
nonadecaoxa-2,62-diazahexahexacontan-66-oic acid

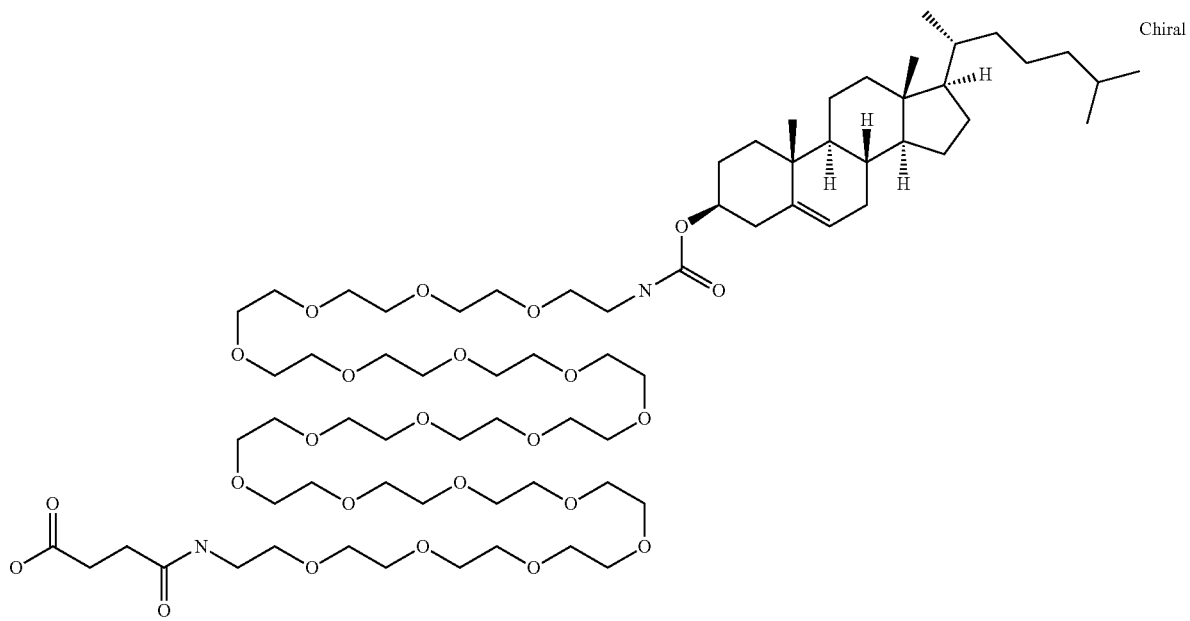

The amine from step a (329 mg, 0.251 mmol), succinic anhydride (26.4 mg, 0.264 mmol) and triethylamine (40 uL, 0.286 mmol) were dissolved in 5 mL dry dichloromethane. After adding more triethylamine (40 uL, 0.286 mmol), the solution (pH>8) was stirred overnight at room temperature. The reaction was diluted with dichloromethane and washed twice with a KHSO4 5%/K2SO4 10% aqueous mixture. The organic extract was dried over anhydrous MgSO4, filtered and evaporated to obtain the product (260 mg, 0.175 mmol) as a colorless, waxy solid. MS (ISP): (M+NH4) 1408.9

The following working examples illustrate the invention:

Example 34

General Procedure for the Preparation of RNA Conjugates

Materials

Dimethyl sulfoxide (DMSO), N,N-Diisopropylethylamine (DIPEA) and sodium acetate solution (3 M, pH 5.2) were purchased from Sigma Aldrich Chemie GmbH (Traufkirchen, Germany).

Triethylammonium acetate (TEAA) (2.0 M, pH 7.0) and Acetonitrile (ACN, HPLC quality) for RP-HPLC were purchased from Biosolve (Valkenswaard, Netherlands).

Ethanol (EtOH, p.a.) was purchased from Merck (Darmstadt, Germany). Purified water from a Optilab HF (Membra Pure, Germany) system was used.

Resource RPC 3 mL column (10×0,64 cm; 15 μm particle size) was purchased from GE Healthcare (Freiburg, Germany).

HPLC purification was accomplished using an AKTA Explorer 100 system (GE Healthcare).

Synthesis of Amino-Modified RNA

RNA equipped with a hexylaminolinker at the 5'-end of the sense strand was produced by standard phosphoramidite chemistry on solid phase at a scale of 1215 μmol=01 using an AKTA Oligopilot 100 (GE Healthcare, Freiburg, Germany) and controlled pore glass as solid support (Prime Synthesis, Aston, Pa., USA). RNA containing 2'-O-methyl nucleotides were generated employing the corresponding phosphoramidites, 2'-O-methyl phosphoramidites and TFA-hexylaminolinker amidite (Sigma-Aldrich, SAFC, Hamburg, Germany). Cleavage and deprotection as well as purification was achieved by methods known in the field (Wincott F., et al, NAR 1995, 23, 14, 2677-84).

The amino-modified RNA was characterized by anion exchange HPLC (purity: 96.1%) and identity was confirmed by ESI-MS ([M+H]1+ calculated: 6937.4; [M+H] 1+ measured: 6939.0.

Sequence: 5'-(NH2C6)GGAAUCuuAuAuuuGAUC-cAsA-3' (SEQ ID NO: 283); u, c: 2'-O-methyl nucleotides of corresponding RNA nucleotides, s: phosphorthioate.

General Experimental Conjugation Procedure

The title compounds of examples 1-33 were coupled via the amino-modified RNA according the following procedure:

RNA equipped with a C-6 aminolinker at the 5'-end (16.5 mg, 1 equivalent) is dissolved in 500 μL DMSO and 150 μL water. The p-Nitrophenylcarbonate derivative (10 equivalents) dissolved in 1 mL DMSO is added followed by 8 μL DIPEA. The reaction mixture is shaken at 35° C. in the dark and monitored using RP-HPLC (Resource RPC 3 mL, buffer: A: 0.1M TEAA in water, B: 0.1M TEAA in 95% ACN, gradient: 3% B to 100% B in 20 CV). Once the reaction is gone to completion the RNA conjugate is precipitated using sodium acetate (3 M) in EtOH at −20° C. For examples lacking a MMT protecting group in the dipeptide motif the corresponding conjugates are purified using the conditions described above. Pure fractions are pooled and the material is precipitated using sodium acetate/EtOH to give the desired RNA conjugate.

RNA conjugates containing a MMT protecting group in the dipeptide sequence are further processed according to the procedure given below.

General Procedure for MMT Cleavage

The crude RNA conjugate pellet is dissolved in 500 μL water and 1.5 mL sodium acetate buffer (3 M, pH 5.2 or 0.1M, pH 4.0). The solution is shaken for 2 days at 30° C. The reaction mixture is monitored using RP-HPLC (Resource RPC 3 mL, buffer: A: 0.1M TEAA in water, B: 0.1M TEAA in 95% ACN, gradient: 3% B to 100% B in 20 CV). After complete cleavage of the MMT protecting group the RNA conjugate is directly purified using the conditions just mentioned above. Pure fractions are pooled and the desired conjugate is precipitated using sodium acetate/EtOH.

As a control a RNA conjugate lacking the dipeptide motif was synthesized. For this purpose cholesterol was attached to the 5'-end via a linker described in the literature (Nature Biotech, 2007, 25, 1149). This conjugate is referred to as "non-cleavable".

All the RNA conjugates were analyzed by RP HPLC for purity and identity was confirmed by ESI MS (negative mode). Briefly, RP-HPLC was performed on a Dionex Ultimate system (Dionex, Idstein, Germany) equipped with a XBridge C18 column (2.5×50 mm, 2.5 μm particle size, Waters, Eschborn, Germany) at 65° C. column temperature. Gradient elution was performed using 100 mM hexafluoroisopropanol (HFIP) and 16 mM triethylamine in 1% methanol as eluent A and in 95% methanol as eluent B (1% B to 18% B in 30 minutes). UV detection was recorded at 260 nm. For mass spectrometric analysis a ThermoFinnigan LCQ DecaXP ESI-MS system with micro-spray source and ion trap detector was coupled online to the HPLC system.

Examples of specific compounds of formula (IIa) are disclosed in table 1. The resulting compounds are referred to "di-peptide containing cholesterol siRNA conjugates", wherein the specific di-peptide containing cholesterol siRNA conjugates are further referred to as "Title compound example X— (NHC6)-(siRNA sequence)" and "siRNA with Title compound of Example X".

siRNA Preparation

Antisense sequence: 5'-uuGGAUcAAAuAuAAGA-uUCcscsU-3' (SEQ ID NO: 154)

u, c: 2'-O-methyl nucleotides of corresponding RNA nucleotides, s: phosphorthioate The di-peptide containing cholesterol siRNA conjugates directed against the apolipoprotein B mRNA were generated by mixing an equimolar solution of complementary strands in annealing buffer (20 mM sodium phosphate, pH 6.8; 100 mM sodium chloride), heated in a water bath at 80-85° C. for 3 minutes and cooled to room temperature over a period of 3-4 hours. Duplex formation was confirmed by native gel electrophoresis.

All prepared di-peptide containing cholesterol siRNA conjugates are listed in table 2.

TABLE 1

Di-peptide containing cholesterol siRNA conjugates (5'-3') and analytical data.

| Title compound from example No. | | Base sequence SEQ ID NO: | Mol mass calc. | Mol mass exp. | Purity (%) (RP) |
|---|---|---|---|---|---|
| 16 | (Title compound Ex 16) (NHC6) GGAAUCuuAuAuuuGAUCcASA | 284 | 7885.7 | 7887.5 | 94.4 |
| 31 | (Title compound Ex 16) (NHC6) GGAAUCuuAuAuuuGAUCcASA | 284 | 8003.8 | 8003.3 | 97.3 |
| 33 | (Title compound Ex 33) (NHC6) GGAAUCuuAuAuuuGAUCcASA | 284 | 8752.7 | 8752.4 | 97.6 |
| 32 | (Title compound Ex 32) (NHC6) GGAAUCuuAuAuuuGAUCcASA | 284 | 8223.1 | 8226.5 | 97.3 |
| 17 | (Title compound Ex 17) (NHC6) GGAAUCuuAuAuuuGAUCcASA | 284 | 7870.7 | 7873.5 | 90.6 |
| 30 | (Title compound Ex 30) (NHC6) GGAAUCuuAuAuuuGAUCcASA | 284 | 7884.8 | 7888.8 | 95.2 |
| 27 | (Title compound Ex 27) (NHC6) GGAAUCuuAuAuuuGAUCcASA | 284 | 7840.0 | 7840.0 | 94.8 |
| 28 | (Title compound Ex 28) (NHC6) GGAAUCuuAuAuuuGAUCcASA | 284 | 7755.4 | 7754.9 | 93.2 |
| 29 | (Title compound Ex 29) (NHC6) GGAAUCuuAuAuuuGAUCcASA | 284 | 7840.4 | 7839.9 | 87.2 |
| 1 | (Title compound Ex 1) (NHC6) GGAAUCuuAuAuuuGAUCcASA | 284 | 7931.1 | 7935.2 | 98.2 |
| 2 | (Title compound Ex 2) (NHC6) GGAAUCuuAuAuuuGAUCcASA | 284 | 7992.2 | 7995.0 | 96.7 |
| 3 | (Title compound Ex 3) (NHC6) GGAAUCuuAuAuuuGAUCcASA | 284 | 7911.1 | 7913.8 | 98.2 |
| 4 | (Title compound Ex 4) (NHC6) GGAAUCuuAuAuuuGAUCcASA | 284 | 7955.1 | 7958.5 | 98.0 |
| 5 | (Title compound Ex 5) (NHC6) GGAAUCuuAuAuuuGAUCcASA | 284 | 7920.5 | 7923.9 | 97.2 |
| 6 | (Title compound Ex 6) (NHC6) GGAAUCuuAuAuuuGAUCcASA | 284 | 7936.1 | 7939.6 | 98.5 |
| 7 | (Title compound Ex 7) (NHC6) GGAAUCuuAuAuuuGAUCcASA | 284 | 7904.2 | 7905.5 | 95.1 |
| 8 | (Title compound Ex 8) (NHC6) GGAAUCuuAuAuuuGAUCcASA | 284 | 7904.2 | 7908.7 | 98.8 |
| 9 | (Title compound Ex 9) (NHC6) GGAAUCuuAuAuuuGAUCcASA | 284 | 7904.2 | 7906.7 | 98.7 |

TABLE 1-continued

Di-peptide containing cholesterol siRNA conjugates (5'-3') and analytical data.

| Title compound from example No. | | Base sequence SEQ ID NO: | Mol mass calc. | Mol mass exp. | Purity (%) (RP) |
|---|---|---|---|---|---|
| 10 | (Title compound Ex 10)(NHC6)GGAAUCuuAuAuuuGAUCcASA | 284 | 7918.2 | 7921.0 | 95.4 |
| 11 | (Title compound Ex 11)(NHC6)GGAAUCuuAuAuuuGAUCcASA | 284 | 7902.0 | 7901.5 | 98.7 |
| 12 | (Title compound Ex 12)(NHC6)GGAAUCuuAuAuuuGAUCcASA | 284 | 7934.54 | 7936.5 | 94.4 |
| 13 | (Title compound Ex 13)(NHC6)GGAAUCuuAuAuuuGAUCcASA | 284 | 7916.09 | 7917.9 | 96.5 |
| 14 | (Title compound Ex 14)(NHC6)GGAAUCuuAuAuuuGAUCcASA | 284 | 7886.07 | 7888.3 | 94.9 |
| 24 | (Title compound Ex 24)(NHC6)GGAAUCuuAuAuuuGAUCcASA | 284 | 7781.8 | 7783.4 | 97.2 |
| 23 | (Title compound Ex 23)(NHC6)GGAAUCuuAuAuuuGAUCcASA | 284 | 7815.8 | 7817.3 | 95.2 |
| 22 | (Title compound Ex 22)(NHC6)GGAAUCuuAuAuuuGAUCcASA | 284 | 7781.8 | 7783.9 | 90.5 |
| 26 | (Title compound Ex 26)(NHC6)GGAAUCuuAuAuuuGAUCcASA | 284 | 7905.9 | 7907.0 | 96.4 |
| 25 | (Title compound Ex 25)(NHC6)GGAAUCuuAuAuuuGAUCcASA | 284 | 7871.9 | 7873.2 | 96.1 |
| 20 | (Title compound Ex 20)(NHC6)GGAAUCuuAuAuuuGAUCcASA | 284 | 7840.7 | 7840.0 | 95.9 |
| 19 | (Title compound Ex 19)(NHC6)GGAAUCuuAuAuuuGAUCcASA | 284 | 7857.8 | 7856.6 | 97.3 |
| 18 | (Title compound Ex 18)(NHC6)GGAAUCuuAuAuuuGAUCcASA | 284 | 7741.6 | 7741.1 | 93.9 |
| 21 | (Title compound Ex 21)(NHC6)GGAAUCuuAuAuuuGAUCcASA | 284 | 7798.6 | 7797.8 | 87.6 |
| 15 | (Title compound Ex 15)(NHC6)GGAAUCuuAuAuuuGAUCcASA | 284 | 7927.1 | 7926.8 | 97.2 |

Key: lower case letters a, c, g, u, are 2'-O-Methyl nucleotides; A phosphorothioate linkages is symbolized with a lower case "s". (NHC6) is the aminohexyl linker incorporated at the 5'-end of the sense strand.

TABLE 2

Di-peptide containing cholesterol siRNA conjugates. The last entry (SEQ ID NO pair 266/154) represents a siRNA conjugate lacking the di-peptide motif.

| Base sequence SEQ ID No | Sense sequence (5'-3') | SEQ ID No | Antisense sequence (5'-3') |
|---|---|---|---|
| 284 | (Title compound Ex16)(NHC6) GGAAUCuuAuAuuuGAUCcAsA | 154 | uuGGAUcAAAuAuAAGAuUCcscsU |
| 284 | (Title compound Ex 31)(NHC6) GGAAUCuuAuAuuuGAUCcAsA | 154 | uuGGAUcAAAuAuAAGAuUCcscsU |
| 284 | (Title compound Ex 33)(NHC6) GGAAUCuuAuAuuuGAUCcAsA | 154 | uuGGAUcAAAuAuAAGAuUCcscsU |
| 284 | (Title compound Ex 32)(NHC6) GGAAUCuuAuAuuuGAUCcAsA | 154 | uuGGAUcAAAuAuAAGAuUCcscsU |
| 284 | (Title compound Ex 17)(NHC6) GGAAUCuuAuAuuuGAUCcAsA | 154 | uuGGAUcAAAuAuAAGAuUCcscsU |
| 284 | (Title compound Ex 30)(NHC6) GGAAUCuuAuAuuuGAUCcAsA | 154 | uuGGAUcAAAuAuAAGAuUCcscsU |
| 284 | (Title compound Ex 27)(NHC6) GGAAUCuuAuAuuuGAUCcAsA | 154 | uuGGAUcAAAuAuAAGAuUCcscsU |
| 284 | (Title compound Ex 28)(NHC6) GGAAUCuuAuAuuuGAUCcAsA | 154 | uuGGAUcAAAuAuAAGAuUCcscsU |
| 284 | (Title compound Ex 29)(NHC6) GGAAUCuuAuAuuuGAUCcAsA | 154 | uuGGAUcAAAuAuAAGAuUCcscsU |

TABLE 2-continued

Di-peptide containing cholesterol siRNA conjugates. The last entry (SEQ ID NO pair 266/154) represents a siRNA conjugate lacking the di-peptide motif.

| Base sequence SEQ ID No | Sense sequence (5'-3') | SEQ ID No | Antisense sequence (5'-3') |
| --- | --- | --- | --- |
| 284 | (Title compound Ex 1)(NHC6) GGAAUCuuAuAuuuGAUCcAsA | 154 | uuGGAUcAAAuAuAAGAuUCcscsU |
| 284 | (Title compound Ex 2)(NHC6) GGAAUCuuAuAuuuGAUCcAsA | 154 | uuGGAUcAAAuAuAAGAuUCcscsU |
| 284 | (Title compound Ex 3)(NHC6) GGAAUCuuAuAuuuGAUCcAsA | 154 | uuGGAUcAAAuAuAAGAuUCcscsU |
| 284 | (Title compound Ex 4)(NHC6) GGAAUCuuAuAuuuGAUCcAsA | 154 | uuGGAUcAAAuAuAAGAuUCcscsU |
| 284 | (Title compound Ex 5)(NHC6) GGAAUCuuAuAuuuGAUCcAsA | 154 | uuGGAUcAAAuAuAAGAuUCcscsU |
| 284 | (Title compound Ex 6)(NHC6) GGAAUCuuAuAuuuGAUCcAsA | 154 | uuGGAUcAAAuAuAAGAuUCcscsU |
| 284 | (Title compound Ex 7)(NHC6) GGAAUCuuAuAuuuGAUCcAsA | 154 | uuGGAUcAAAuAuAAGAuUCcscsU |
| 284 | (Title compound Ex 8)(NHC6) GGAAUCuuAuAuuuGAUCcAsA | 154 | uuGGAUcAAAuAuAAGAuUCcscsU |
| 284 | (Title compound Ex 9)(NHC6) GGAAUCuuAuAuuuGAUCcAsA | 154 | uuGGAUcAAAuAuAAGAuUCcscsU |
| 284 | (Title compound Ex 10)(NHC6) GGAAUCuuAuAuuuGAUCcAsA | 154 | uuGGAUcAAAuAuAAGAuUCcscsU |
| 284 | (Title compound Ex 11)(NHC6) GGAAUCuuAuAuuuGAUCcAsA | 154 | uuGGAUcAAAuAuAAGAuUCcscsU |
| 284 | (Title compound Ex 12)(NHC6) GGAAUCuuAuAuuuGAUCcAsA | 154 | uuGGAUcAAAuAuAAGAuUCcscsU |
| 284 | (Title compound Ex 13)(NHC6) GGAAUCuuAuAuuuGAUCcAsA | 154 | uuGGAUcAAAuAuAAGAuUCcscsU |
| 284 | (Title compound Ex 14)(NHC6) GGAAUCuuAuAuuuGAUCcAsA | 154 | uuGGAUcAAAuAuAAGAuUCcscsU |
| 284 | (Title compound Ex 24)(NHC6) GGAAUCuuAuAuuuGAUCcAsA | 154 | uuGGAUcAAAuAuAAGAuUCcscsU |
| 284 | (Title compound Ex 23)(NHC6) GGAAUCuuAuAuuuGAUCcAsA | 154 | uuGGAUcAAAuAuAAGAuUCcscsU |
| 284 | (Title compound Ex 22)(NHC6) GGAAUCuuAuAuuuGAUCcAsA | 154 | uuGGAUcAAAuAuAAGAuUCcscsU |
| 284 | (Title compound Ex 26)(NHC6) GGAAUCuuAuAuuuGAUCcAsA | 154 | uuGGAUcAAAuAuAAGAuUCcscsU |
| 284 | (Title compound Ex 25)(NHC6) GGAAUCuuAuAuuuGAUCcAsA | 154 | uuGGAUcAAAuAuAAGAuUCcscsU |
| 284 | (Title compound Ex 20)(NHC6) GGAAUCuuAuAuuuGAUCcAsA | 154 | uuGGAUcAAAuAuAAGAuUCcscsU |
| 284 | (Title compound Ex 19)(NHC6) GGAAUCuuAuAuuuGAUCcAsA | 154 | uuGGAUcAAAuAuAAGAuUCcscsU |
| 284 | (Title compound Ex 18)(NHC6) GGAAUCuuAuAuuuGAUCcAsA | 154 | uuGGAUcAAAuAuAAGAuUCcscsU |
| 284 | (Title compound Ex 21)(NHC6) GGAAUCuuAuAuuuGAUCcAsA | 154 | uuGGAUcAAAuAuAAGAuUCcscsU |

TABLE 2-continued

Di-peptide containing cholesterol siRNA conjugates . The last entry (SEQ ID NO pair 266/154) represents a siRNA conjugate lacking the di-peptide motif.

| Base sequence SEQ ID No | Sense sequence (5'-3') | SEQ ID No | Antisense sequence (5'-3') |
|---|---|---|---|
| 284 | (Title compound Ex 15)(NHC6) GGAAUCuuAuAuuuGAUCcAsA | 154 | uuGGAUcAAAuAuAAGAuUCcscsU |
| 285 | (Chol)GGAAUCuuAuAuuuGAUCcAsA | 154 | uuGGAUcAAAuAuAAGAuUCcscsU |

Key: lower case letters a, c, g, u, are 2'-O-Methyl nucleotides; A phosphorothioate linkages is symbolized with a lower case "s". (NHC6) is the aminohexyl linker incorporated at the 5'-end of the sense strand.

Example 35

In Vivo Experiments

Co-Administration of di-peptide containing cholesterol siRNA conjugates and delivery polymer in vivo.

Six to eight week old mice (strain C57BL/6 or ICR, ~18-20 g each) were obtained from Harlan Sprague Dawley (Indianapolis Ind.). Mice were housed at least 2 days prior to injection. Feeding was performed ad libitum with Harlan Teklad Rodent Diet (Harlan, Madison Wis.).

Mice (n=3 per group) were injected with a mixture of 0.2 mL solution of delivery polymer and 0.2 ml di-peptide containing cholesterol siRNA conjugates. The injected dose was, unless otherwise stated, 15 mg/kg for the delivery polymer and 0.1 mg/kg with respect to the di-peptide containing cholesterol siRNA conjugates. Solutions were injected by infusion into the tail vein. 48 hours post injection serum ApoB levels were measured relative to isotonic glucose treated animals according to the procedure below.

Serum ApoB Levels Determination.

Mice were fasted for 4 h before serum collection by submandibular bleeding. Serum ApoB protein levels were determined by standard sandwich ELISA methods. Briefly, a polyclonal goat anti-mouse ApoB antibody and a rabbit anti-mouse ApoB antibody (Biodesign International) were used as capture and detection antibodies respectively. An HRP-conjugated goat anti-rabbit IgG antibody (Sigma) was applied afterwards to bind the ApoB/antibody complex. Absorbance of tetramethyl-benzidine (TMB, Sigma) colorimetric development was then measured by a Tecan Safire2 (Austria, Europe) microplate reader at 450 nm.

Figure 1:
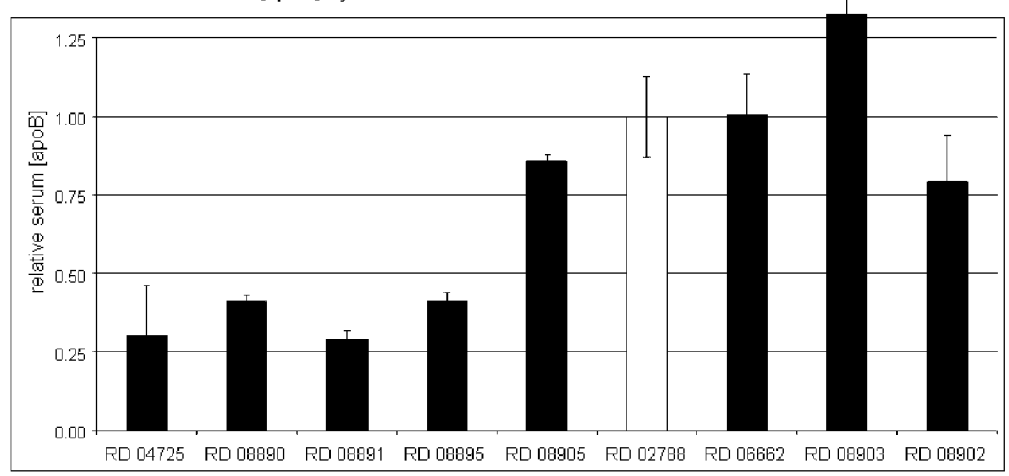
FIG. 1 shows Co-Administration of siRNA-conjugates comprising the compounds of formula (I) or (Ia) and a delivery polymer in vivo.

In FIG. 1 various di-peptide containing cholesterol siRNA conjugates were benchmarked against the same siRNA conjugated to cholesterol but lacking the cleavable motif elaborated earlier in this section. The effect of this siRNA conjugate (SEQ ID NO pair 266/154, "non-cleavable control") on serum ApoB levels was set to 1 in order to evaluate the influence of the di-peptide containing conjugates relative to the non-cleavable control. Substituting the initially used Phe-Lys motif (siRNA with Title compound of Example 16) with the corresponding D-amino acids (siRNA with Title compound of Example 14) or just replacing the Lys with the unnatural enantiomer (siRNA with Title compound of Example 30) yielded ApoB reduction less pronounced or equivalent to the non-cleavable control siRNA. Replacing Lys by Gly (siRNA with Title compound of Example 23) or Phe by p-Methoxyphenylalanine (siRNA with Title compound of Example 13) reduced the potency compared to siRNA with Title compound of Example 16. Other di-peptide motifs containing siRNA conjugates were shown to be as efficacious as the original Phe-Lys containing conjugate.

Figure 2:
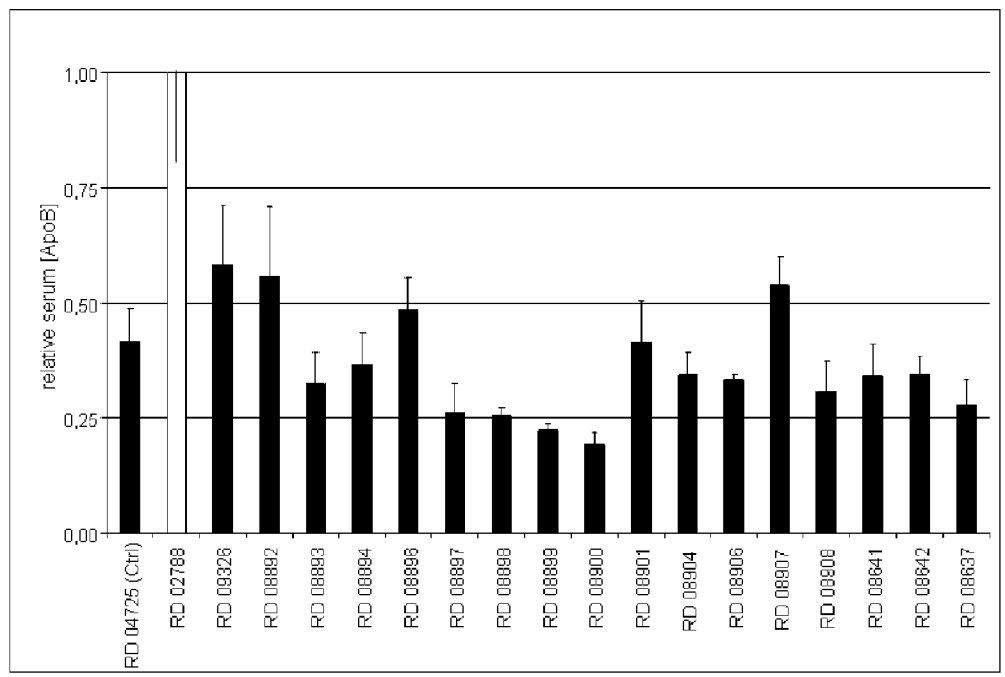
FIG. 2 shows Co-Administration of siRNA-conjugates comprising the compounds of formula (I) or (Ia) and a delivery polymer in vivo.

FIG. 2 summarizes di-peptide containing cholesterol siRNA conjugates that were as efficacious or had improved efficacy compared to siRNA with Title compound of Example 16 consisting of the Phe-Lys motif. All these conjugates were significantly more active compared to the "non-cleavable" cholesterol siRNA conjugate SEQ ID NO pair 266/154. The best performing di-peptide containing cholesterol siRNA conjugates had a fluorine modified phenyl ring in the Phy-Lys motif (siRNA with Title compound of Example 8, siRNA with Title compound Example 9) or had the phenylalanine substituted with beta-phenylalanine (siRNA with Title compound of Example 11) or a derivative thereof (siRNA with Title compound of Example 10).

Since di-peptide containing cholesterol siRNA conjugates with di-peptide motifs consisting of D-amino acids are performing equal to the non-cleavable control conjugate it is conceivable that the other di-peptide sequences are indeed cleaved by a protease activity in vivo. However, given the broad acceptance of different amino acids and derivatives thereof it is likely that more than one enzyme is participating in the cleavage reaction as suggested in the literature (Bioconjugate Chem. 2002, 13, 855).

Figure 3:
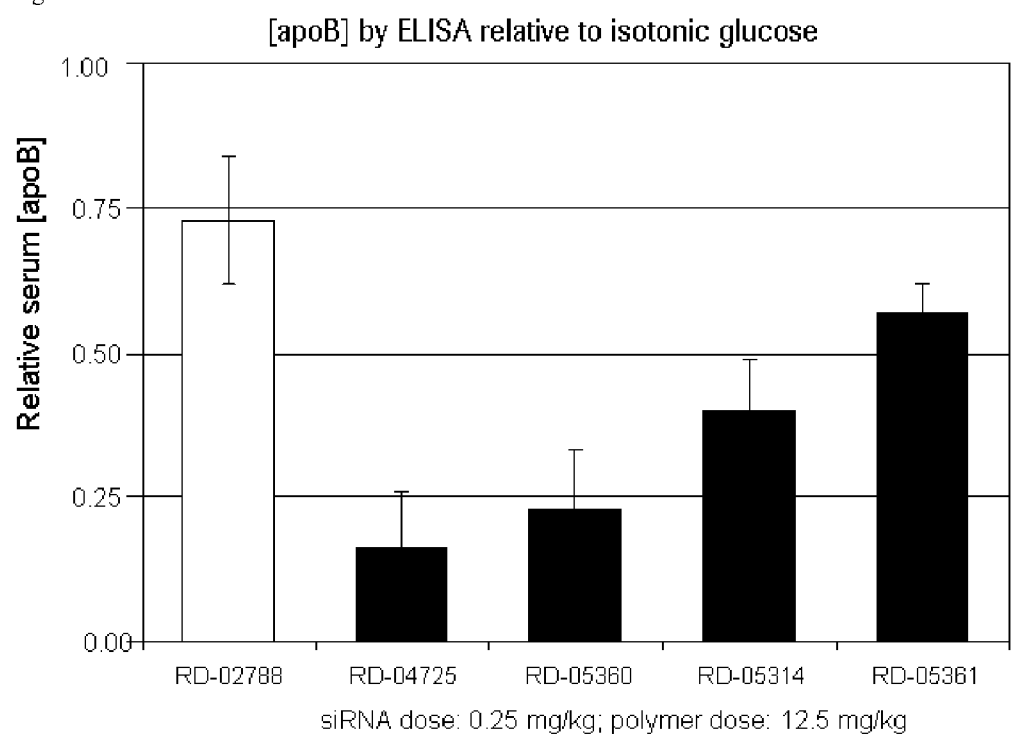
FIG. 3 shows Co-Administration of siRNA-conjugates comprising the compounds of formula (I) or (Ia) and a delivery polymer in vivo.

As shown in FIG. 3, the incorporation of a Cathepsin cleavable di-peptide motif (in this case Phe-Lys, siRNA with Title compound of Example 16) between the siRNA and the small molecule ligand cholesterol boosts the potency of the siRNA conjugate compared to the straight cholesterol siRNA conjugate (SEQ ID NO pair 266/154). Further spacing of the cholesterol ligand from the di-peptide motif by means of PEG based linkers diminishes the potency proportional to the length of the PEG linker.

Figure 4:
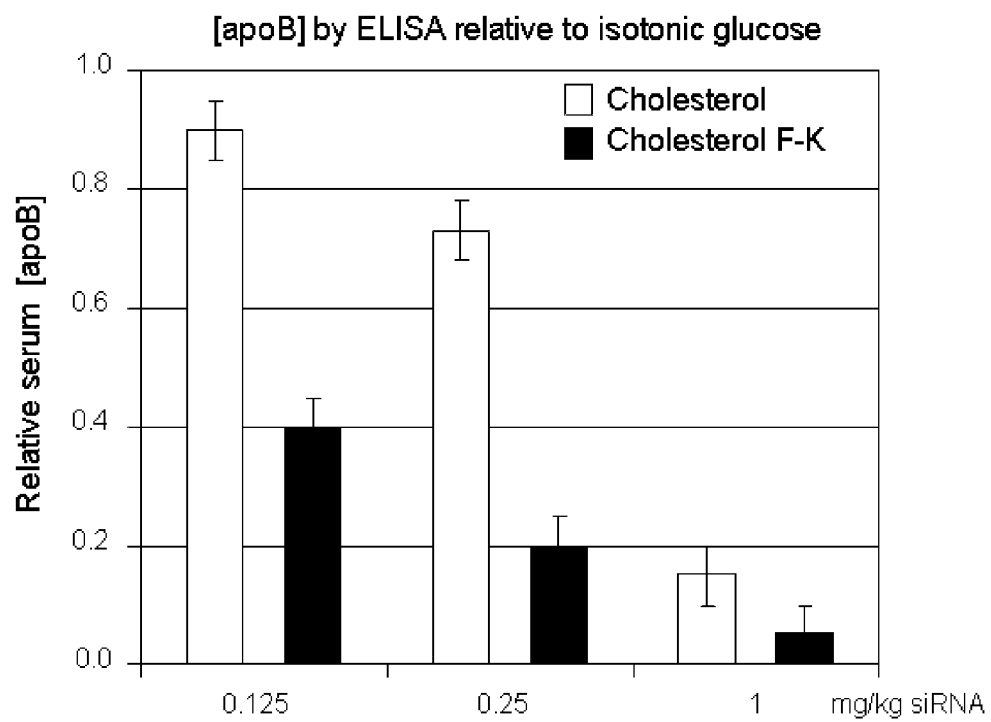
FIG. 4 shows Co-Administration of siRNA-conjugates comprising the compounds of formula (I) or (Ia) and a delivery polymer in vivo.

In FIG. 4 the polymer dose was kept constant at 15 mg/kg. The siRNA dose was titrated and the effect on serum ApoB content was measured. The Di-peptide containing cholesterol siRNA conjugates containing the Phe-Lys (F-K) motif was significantly more potent compared to the control conjugate lacking the di-peptide sequence.

Example 36

2'-modified oligoribonucleotide synthesis

Oligoribonucleotides were synthesized according to the phosphoramidite technology on solid phase. Depending on the scale either an ABI 394 synthesizer (Applied Biosystems) or an AKTA oligopilot 100 (GE Healthcare, Freiburg, Germany) was used. Syntheses were performed on a solid support made of controlled pore glass (CPG, 520 Å, with a loading of 75 µmol/g, obtained from Prime Synthesis, Aston, Pa., USA). All 2'-modified RNA phosphoramidites as well as ancillary reagents were purchased from SAFC (Hamburg, Germany). Specifically, the following 2'-O-Methyl phosphoramidites were used: (5'-O-dimethoxytrityl-N6-(benzoyl)-2'-O-methyl-adenosine-3'-O-(2-cyanoethyl-N,N-diisopropylamino) phosphoramidite, 5'-O-dimethoxytrityl-N4-(acetyl)-2'-O-methyl-cytidine-3'-O-(2-cyanoethyl-N,N-diisopropylamino) phosphoramidite, (5'-O-dimethoxytrityl-N2-(isobutyryl)-2'-O-methyl-guanosine-3'-O-(2-cyanoethyl-N,N-diisopropylamino) phosphoramidite, and 5'-O-dimethoxytrityl-2'-O-methyl-uridine-3'-O-(2-cyanoethyl-N,N-diisopropylamino) phosphoramidite. The 2'-Deoxy-2'-fluoro-phosphoramidites carried the same protecting groups as the 2'-O-methyl RNA amidites. All amidites were dissolved in anhydrous acetonitrile (100 mM) and molecular sieves (3 Å) were added. To generate the 5'-phosphate the 2-[2-(4,4'-Dimethoxytrityloxy)ethylsulfonyl]ethyl-(2-cyanoethyl)-(N,N-diisopropyl)-phosphoramidite from Glen Research (Sterling, Va., USA) was used. In order to introduce the C-6 aminolinker at the 5'-end of the oligomers the 6-(Trifluoroacetylamino)-hexyl-(2-cyanoethyl)-(N,N-diisopropyl)-phosphoramidite from Thermo Fisher Scientific (Milwaukee, Wis., USA) was employed. The 5'-modifications were introduced without any modification of the synthesis cycle. 5-Ethyl thiotetrazole (ETT, 500 mM in acetonitrile) was used as activator solution. Coupling times were 6 minutes. In order to introduce phosphorothioate linkages a 50 mM solution of 3-((Dimethylamino-methylidene)amino)-3H-1,2,4-dithiazole-3-thione (DDTT, obtained from AM Chemicals, Oceanside, Calif., USA) in anhydrous Acetonitrile/pyridine (1:1 v/v) was employed.

Example 37

Cleavage and Deprotection of Support Bound Oligomer

After finalization of the solid phase synthesis, the dried solid support was transferred to a 15 mL tube and treated with concentrated aqueous ammonia (Aldrich) for 18 hours at 40° C. After centrifugation the supernatant was transferred to a new tube and the CPG was washed with aqueous ammonia. The combined solutions were evaporated and the solid residue was reconstituted in buffer A (see below).

Example 38

Purification of Oligoribonucleotides

Crude oligomers were purified by anionic exchange HPLC using a column packed with Source Q15 (GE Helthcare) and an AKTA Explorer system (GE Helthcare). Buffer A was 10 mM sodium perchlorate, 20 mM Tris, 1 mM EDTA, pH 7.4 (Fluka, Buchs, Switzerland) and contained 20% Acetonitrile and buffer B was the same as buffer A with the exception of 500 mM sodium perchlorate. A gradient of 22% B to 42% B within 32 column volumes (CV) was employed. UV traces at 280 nm were recorded Appropriate fractions were pooled and precipitated with 3M NaOAc, pH=5.2 and 70% Ethanol. Finally, the pellet was washed with 70% Ethanol.

Example 39

Annealing of Oligoribonucleotides to Generate siRNA

Complementary strands were mixed by combining equimolar RNA solutions. The mixture was lyophilized and reconstituted with an appropriate volume of annealing buffer (100 mM NaCl, 20 mM sodium phosphate, pH 6.8) to achieve the desired concentration. This solution was placed into a water bath at 85° C. which was cooled to rt. within 3 h.

Example 40

In vitro Activity of siRNAs Devoid of 2'-OH Residues

In order to investigate if siRNAs lacking any 2'-OH residues show potent in vitro knock down activity, we tested a panel of EGFP mRNA-targeted siRNAs with different 2'-modification chemistries (SEQ ID pairs 31/32 to 149/150, and see Table 3 for examples). The siRNAs were screened for sense and antisense activity with the Dual-Glo® Luciferase Assay System (Promega) using the psiCHECK2 vector (Promega) in COS7 cells (DSMZ, Braunschweig, Germany, cat. No. ACC-60). To address the silencing activity conferred by sense and antisense strand we cloned each corresponding 19mer target site sequence as separate psiCHECK2 construct (psiCHECK2-AT for antisense activity, psiCHECK2-ST for sense activity) into the multiple cloning region located 3' to the translational stop codon of the synthetic Renilla luciferase. By using Lipofectamine 2000 (Invitrogen GmbH, Karlsruhe, Germany, cat. No. 11668-019) COS7 cells were co-transfected with vector construct and 3 nM of the corresponding siRNA complementary to the cloned target site. Successful siRNA-mediated silencing was determined 24 hours after transfection via the activity of the renilla luciferase normalized to firefly luciferase levels to take transfection efficiency into account (see FIG. 5a for antisense activity and FIG. 5b for sense activity).

TABLE 3

Exemplary siRNA sequences and chemical modifications used for determination of in vitro knock down activity dependent on 2'-modifications. Reference duplices and selected examples of corresponding modification variants used in this study.

| RNA duplices | | | |
|---|---|---|---|
| Unmod | 5'- | UGCCCAUCCUGGUCGAGCUTT -3' | (SEQ ID NO: 286) |
| | 3'- | TTACGGGUAGGACCAGCUCGAp -5' | (SEQ ID NO: 287) |

TABLE 3-continued

Exemplary siRNA sequences and chemical modifications used for determination of in vitro knock down activity dependent on 2'-modifications. Reference duplices and selected examples of corresponding modification variants used in this study.

RNA duplices

```
F/OMe    5'-  UfgCfcCfaUfcCfuGfgUfcGfaGfcUfTs          (SEQ ID NO: 288)
              T -3'
         3f-  TsTaCfgGfgUfaGfgAfcCfaGfcUfcGfap  -5'(SEQ ID NO: 289)

F/DNA    5'-  UfGCfcCCfAUfCCfUGfGUfCGfAGfCUfTs          (SEQ ID NO: 290)
              T -3'
         3'-  TsTACfGGfGUfAGfGAfCCfAGfCUfCGfAp  -5'(SEQ ID NO: 291)

DNA/OMe  5'-  UgCcCaUcCuGgUcGaGcUTsT  -3'               (SEQ ID NO: 292)
         3'-  TsTaCgGgUaGgAcCaGcUcGap  -5'              (SEQ ID NO: 293)
```

Xf indicates a 2'-fluoro modification of the nucleotide X, small letters indicate a 2'-O-methyl modification, underlined letters indicate a DNA nucleotide, all other capital letters indicate ribonucleotides. The letter "p" indicates a 5'-phosphate.

It was found that the 5 most potent modified siRNAs (>60% knock-down) were designed in an alternating 2'-fluoro/2'-O-methyls (2'F/2'-OMe) pattern. While conferring antisense activity, this chemistry fully eliminated the activity of the corresponding sense strands, as shown by lack or minimal renilla luciferase activity for all tested 2'F/2'-OMe variants.

We concluded that such 2'F/2'-OMe pattern is promoting the siRNA's intended antisense strand activity while undesired off-target effects coming from the sense strand are fully suppressed.

Example 41

Detection of DNAse II-Sensitive Sites by In Vitro Assay

An ion pairing (IP) reversed phase (RP) high performance liquid chromatography (HPLC) coupled to an electrospray ionization (ESI) mass spectrometry (MS) or an anion exchange (AEX)-HPLC based method was established to test the in vitro stability of selected single and double stranded RNAs.

Method description: For stability analysis a 10 µM solution of either single stranded or double stranded RNA was incubated at 37° C. in 5 mM sodium acetate buffer solution (pH 4.5) containing 0.8 or 8 units DNase II (from bovine spleen, Type V, Sigma Aldrich). The incubation reaction was stopped by adding a 100 mM triethyl ammonium acetate (TEAA) solution, shifting the pH to 7 and inactivating the DNase II enzyme. Analysis was done by either LC/MS combined with UV-detection or by AEX-HPLC with UV-detection. UV-detection traces at 260 nm were used for quantitative analysis, MS data served for cleavage site identification within the RNA sequence.

A. IP-RP-HPLC was done employing a Waters XBridge C18 column (2.5×50 mm, 2.5 µm particle size) at 65° C. column temperature. Gradient elution was performed using 100 mM hexafluoroisopropanol (HFIP) and 16 mM triethylamine in 1% methanol as eluent A and composition A in 95% methanol as eluent B. A gradient from 1% B to 18% B in 30 minutes was employed.

B. AEX-HPLC was performed on a Dionex DNA Pac200 column (4×250 mm) at 50° C. using a 20 mM phosphate buffer containing 10% ACN at pH=11. Eluent B contained 1 M NaBr in eluent A. A gradient from 25 to 62% B in 18 minutes was employed.

TABLE 4

Duplexes and the remaining intact strands evaluated for their stability against DNase II.

| SEQ ID NO | Sense strand sequence (5'-3') | % Intact strand after 6 hours | SEQ ID NO | Antisense strand sequence (5'-3') | % Intact strand after 6 hours |
|---|---|---|---|---|---|
| 157 | GGAuGAAGuGGAGAuuAGud TsdT | 0 | 158 | ACuAAUCUCcACUUcAUCCd TsdT | 0.1 |
| 160 | (NH2C6)GfgAfuGfaAfgUfgGfa GfaUfuAfgUf(invdT) | 101 | 159 | pasCfuAfaUfcUfcCfaCfuUfcAf uCfc(invdT) | 97 |
| 165 | (NH2C6)GfcAfaAfgGfcGfuGfc CfaAfcUfcAf(invdT) | 103 | 166 | puGfaGfuUfgGfcAfcGfcCfuUfu Gfc(invdT) | 103 |
| 167 | (NH2C6)GcAAAGGcGuGccAA cucAdTsdT | 56 | 168 | UGAGUUGGcACGCCUUUGC dTsdT | 49 |
| 169 | (NH2C6)GGAUfCfAUfCfUfCf AAGUfCfUfUfACfdTsdT | 64 | 170 | GUfAAGACfUfUfGAGAUfGA UfCfCfdTsdT | 54 |

TABLE 4-continued

Duplexes and the remaining intact strands evaluated for their stability against DNase II.

| SEQ ID NO | Sense strand sequence (5'-3') | % Intact strand after 6 hours | SEQ ID NO | Antisense strand sequence (5'-3') | % Intact strand after 6 hours |
|---|---|---|---|---|---|
| 153 | GGAAUCuuAuAuuuGAUCcAsA | 0.1 | 154 | uuGGAUcAAAuAuAAGAuUCcscsU | 0.1 |
| 173 | (NH2C6)UfgAfcCfaCfaGfuCfgGfaUfuAfaAf(invdT) | 102 | 174 | pusUfuAfaUfcCfgAfcUfgUfgGfuCfa(invdT) | 102 |
| 175 | (NH2C6)uGAccAcAGucGGAuuAAAdTsdT | 0.4 | 176 | puUuAAUCCGACUGUGGucAdTsdT | 0.3 |
| 175 | (NH2C6)uGAccAcAGucGGAuuAAAdTsdT | 6 | 177 | UUuAAUCCGACUGUGGUcAdTsdT | 3 |

Key: lower case letters a, c, g, u, are 2'-O-Methyl nucleotides; Upper case letters A, C, G, U followed by "f" indicates a 2'-fluoro nucleotide. Lower case "p" indicates a 5'-phosphate. (invdT) represents an inverted deoxythimidine (3'-3'-linked). A phosphorothioate linkages is symbolized with a lower case "s". dT is deoxythimidine. (NHC6) is the aminohexyl linker incorporated at the 5'-end of the sense strand.

Conclusions:

A. RNA strands containing at least one 2'-OH nucleotide (e.g. both strands of SEQ ID NO pair 157/158) are rapidly degraded via a cyclic pentavalent intermediate, leading to 2'-3' cyclic phosphates at the 5'-cleavage product. The formation of the pentavalent intermediate can be inhibited using nucleotides lacking a 2'-OH group, like e.g. 2'-deoxy, 2'-OMe or 2'-F.

B. Additionally, RNA is degraded via a 5'-exonucleolytic pathway, that is independent from the 2'-modification on the 5'-terminal nucleotides. This degradation pathway can be inhibited using 5'-terminal non-nucleotide moieties, like e.g. a C6-aminolinker (e.g. SEQ ID NO 160 in SEQ ID NO pair 160/159 or SEQ ID NO 165 in SEQ ID NO pair 165/166) or a phosphorothioate at the first internucleotide linkage (e.g. SEQ ID NO 160 in SEQ ID NO pair 160/159).

C. A 5'-phosphate group slows down the exonucleolytic cleavage kinetics, but can not fully block the degradation starting at this end (e.g. SEQ ID NO 160 in SEQ ID NO pair 160/159). This is most probably due to the cleavage of the 5'-phosphate by either phosphatases or by an inherent phosphatase activity of the DNase II enzyme.

D. The best protection for RNA strands was achieved with oligonucleotides containing no 2'-OH nucleotide, starting with a 2'-OMe nucleotide at the 5'-end connected by a phosphorothioate linkage to the second nucleotide (e.g. SEQ ID NO 173 in SEQ ID NO pair 173/174). Other terminal non-2'-OH nucleotides also protect against the 5'-exo degradation, but to a lower extent compared to the 2'-OMe modification (refer to Table 9)

Example 42

In Vivo Knock Down Activity of siRNAs Devoid of 2'-OH Residues

In vivo experiments were conducted with mice injected with Factor VII (FVII)-targeting siRNAs (SEQ ID NO pairs 179/166 and 180/168, see Table 5) co-administered with DPC-GalNac.

TABLE 5 a

Sequences of siRNAs for in vivo experiment.

| SEQ ID NO pair | SEQ ID NOs | Sequence 5'->3' |
|---|---|---|
| 179/166 | 179 | GalNAc-(NHC6)-GfcAfaAfgGfcGfuGfcCfaAfcUfcAf(invdT) |
| | 166 | puGfaGfuUfgGfcAfcGfcCfuUfuGfc(invdT) |
| 180/168 | 180 | GalNAc-(NHC6)-GcAAAGGcGuGccAAcucAdTsdT |
| | 168 | UGAGUUGGcACGCCUUUGCdTsdT |

Key: lower case letters a, c, g, u, are 2'-O-Methyl nucleotides; Upper case letters A, C, G, U followed by "f" indicates a 2'-fluoro nucleotide. Lower case "p" indicates a 5'-phosphate. (invdT) represents an inverted deoxythimidine (3'-3'-linked). A phosphorothioate linkages is symbolized with a lower case "s". dT is deoxythimidine. (NHC6) is the aminohexyl linker incorporated at the 5'-end of the sense strand. GalNAc refers to the structure in formula (IV).

A FVII siRNA with an alternating 2'-OMe/2'-F pattern on sense and antisense strand was generated with a 5'-terminal 2'-OMe nucleotide on the antisense and a 5'-terminal 2'-F strand on the sense strand. Both strands are protected by an inv(dT) at the 3'-terminal overhang. The antisense strand was bearing a 5'-phosphate group to maintain activity of the siRNA. To the 5'-end of the sense strand a GalNAc-palmitoyl ligand was conjugated to enable targeting to hepatocytes by the asialyloglycoprotein-receptor expressed on these cells. siRNA (2.5 mg/kg) was co-administered with GalNAc-targeted PBAVE delivery polymer (15 mg/kg) in mice.

FVII mRNA measurements were done from liver homogenates using QuantiGene 1.0 branched DNA (bDNA) Assay Kit (Panomics, Fremont, Calif., USA, Cat-No: QG0004).

At necropsy 1-2 g liver tissue was snap frozen in liquid nitrogen. Frozen tissue was powderized with mortar and pistil on dry ice. 15-25 mg of tissue was transferred to a chilled 1.5 mL reaction tube, 1 mL 1:3 Lysis Mixture prediluted in MilliQ water and 3.3 µL Proteinase K(50 µg/µL) was added and tissue was lysed by several seconds ultrasound sonication at 30-50% power (HD2070, Bandelin, Berlin, Germany). Lysates were stored at −80° C. until analysis. For mRNA analysis lysate was thawed and digested with Proteinase K for 15 min at 1000 rpm in a thermomixer at 65° C. (Thermomixer comfort, Eppendorf, Hamburg, Germany). FVII and GAPDH mRNA levels were determined using QuantiGene 1.0 bDNA Assay Kit reagents according to the manufacturer's recommendations. FVII mRNA expression was analyzed using 20 µL lysate and a mouse FVII probe set. GAPDH mRNA expression was analysed using 40 µL lysate and rattus norwegicus probe sets shown to be cross-react with mice (sequences of probesets see above). As assay readout the chemiluminescence signal at end of the assay was measured in a Victor 2 Light luminescence counter (Perkin Elmer, Wiesbaden, Germany) as relative light units (RLU). The signal for FVII mRNA was divided by signal for GAPDH mRNA from the same lysate Values are reported as FVII mRNA expression normalized to GAPDH.

Results demonstrate a 79% FVII mRNA knock down at 48 hours post dosing after administration of SEQ ID NO pair 179/166. In contrast, the 2'-OH nucleotide bearing siRNA SEQ ID NO pair 180/168 showed no significant knock down (<25%), as shown in Table 5.

TABLE 5 b

Results of in vivo knockdown studies

| Time [hour] | SEQ ID NO pair 179/166 Remaining mRNA [%] | SEQ ID NO pair 180/168 Remaining mRNA [%] |
|---|---|---|
| 1 | 84 | 92 |
| 6 | 83 | 88 |
| 24 | 53 | 100 |
| 48 | 21 | 76 |

Example 43

Tissue Distribution of siRNAs Lacking 2'-OH Residues

The siRNA concentration in the liver tissue samples was determined using a proprietary oligonucleotide detection method as described in WO2010043512. Briefly, the siRNA quantification is based on the hybridization of a fluorescently (Atto-425) labeled PNA-probe (Atto425-OO-GCAAAG-GCGTGCCAACT (SEQ ID NO: 270), obtained from Panagene Inc, Korea) complementary to the antisense strand of the siRNA duplex, followed by AEX-HPLC based separation. Quantification was done by fluorescence detection against an external calibration curve that was generated from a dilution series of the two FVII siRNA used in the in vivo experiment (see example 42). For plasma samples between 0.2 to 2 µL and for tissue 1 mg aliquots were injected onto the HPLC system.

Liver tissue analysis of the stabilized siRNA lacking 2'-OH nucleotide showed high concentrations of intact antisense strand in the liver in the ug/g range, but ~95% was present in the 5'-dephosphorylated inactive form (see table 6). The resulting RNA with a terminal 2'-OMe nucleotide is not prone for rephosphorylation in the cytoplasm by the phosphokinase hClp1 (see below). In contrast, the antisense strand of the 2'-OH containing siRNA was completely degraded in the tissue within the first 6 hours post dosing.

TABLE 6

Liver tissue analysis of the stabilized siRNA containing no 2'-OH nucleotide

| Time | SEQ ID NO pair 181/186 in Liver [ng/g] | | SEQ ID NO pair 181/185 in Liver [ng/g] | |
|---|---|---|---|---|
| [hour] | −5'-Phosphat | +5'-Phosphat | −5'-Phosphat | +5'-Phosphat |
| 1 | 873 | 171 | 9 | BDL |
| 6 | 1351 | 106 | BDL* | BDL |
| 24 | 1043 | 65 | BDL | BDL |
| 48 | 1062 | 66 | BDL | BDL |

*BDL = below detection limit

Example 44

In Vitro Knock Down Activity of siRNAs with Optimized 5'-Ends

An additional in vitro screen for FVII siRNAs was conducted in order to identify siRNAs that may be intracellularly (re-)phosphorylated at the antisense's 5'-end to result in the RNAi-competent species. All siRNAs from this screen are shown in Table 7. The alternating 2'-OMe/2'-F modification pattern was identical to the 1st generation design (without any 2'-OH residues) with exception of various modifications at the first two nucleotides at the 5'-end of the antisense strand. The two 5'-terminal nucleotides of the antisense strand were generated as 2'-F or 2'-deoxy modified nucleotides in various combinations with and without an additional 5'-phosphate or 5'-phosphothioate. All siRNAs were screened in dose response (24 nM to 0.00037 nM in 4fold dilutions) for knock down activity after transfection of primary mouse hepatocytes (30000 cells per well; 96 well plate formate) using Lipofectamine 2000 according to the manufacturer's instructions. Two siRNAs were comparable active to the parental duplex (SEQ ID NO pair 182/168); comparable active siRNAs: SEQ ID NO pairs 181/186 and 181/185) in terms of IC50 values, one with a 5'-terminal 2'-F and a phosphate group and one with two 5'-terminal 2'-deoxy nucleotides and a 5'-phosphorothioate (see Table 7 for IC50 values). Both of them are ~5-6-fold more active compared to the siRNA (SEQ ID NO pair 181/166) used in the first animal experiment with the terminal 2'-OMe nucleotide.

Example 45

In vitro 5'-phosphorylation of siRNAs with optimized 5'-termini

All siRNAs without a 5'-phosphate or 5'-phosphorothioate listed in Table 7 were assessed for phosphorylation by hClp1 in a HeLa 5100 cell extract.

5'-phosphorylation s was analyzed from S100 HeLa extracts as described by Weitzer and Martinez (S. Weitzer and J. Martinez. hClp1: a novel kinase revitalizes RNA metabolism. Cell Cycle 6 (17):2133-2137, 2007). Directly after incubation of 1 µM siRNAs in the S100 HeLa extract containing 5 mM ATP, the solution was analyzed by either IP-RP-HPLC or AEX-HPLC under denaturing conditions by injection of 5 µL sample solution:

A. IP-RP-HPLC was done employing a Waters XBridge C18 column (2.5×50 mm, 2.5 µm particle size) at 65° C.

column temperature. Gradient elution was performed using 100 mM hexafluoroisopropanol (HFIP) and 16 mM triethylamine in 1% methanol as eluent A and composition A in 95% methanol as eluent B. A gradient from 1% B to 18% B in 30 minutes was employed.

B. AEX-HPLC was performed on a Dionex DNA Pac200 column (4×250 mm) at 50° C. using a 20 mM phosphate buffer containing 10% ACN at pH=11. Eluent B contained 1 M NaBr in eluent A. A gradient from 25 to 62% B in 18 minutes was employed.

In Table 8 is shown, that the antisense strand of an siRNA cannot be 5'-phosphorylated, when a 2'-OMe nucleotide is located at the 5'-terminus (SEQ ID NO pair 181/196 and SEQ ID NO pair 181/195). In contrast the antisense strand is susceptible to 5'-phosphorylation, when a 2'-F, 2'-deoxy or 2'-OH nucleotide is incorporated at the 5'-terminus (SEQ ID NO pair 181/195, SEQ ID NO pair 181/192, SEQ ID NO pair 181/197, SEQ ID NO pair 181/199 and SEQ ID NO pair 182/168). The

TABLE 7

IC 50 values

| SEQ ID NO | Sense strand sequence (5'-3') | SEQ ID NO | Sense strand sequence (5'-3') | IC50 (nM) |
|---|---|---|---|---|
| 181 | GfcAfaAfgGfcGfuGfcCfaAfcUfcAf(invdT) | 185 | pUfsGfaGfuUfgGfcAfcGfcCfuUfuGfc(invdT) | 0.17 |
| 182 | GcAAAGGcGuGccAAcucAdTsdT | 168 | UGAGUUGGcACGCCUUUGCdTsdT | 0.228 |
| 181 | GfcAfaAfgGfcGfuGfcCfaAfcUfcAf(invdT) | 186 | psdTdGaGfuUfgGfcAfcGfcCfuUfuGfc(invdT) | 0.228 |
| 181 | GfcAfaAfgGfcGfuGfcCfaAfcUfcAf(invdT) | 187 | psdTsGfaGfuUfgGfcAfcGfcCfuUfuGfc(invdT) | 0.554 |
| 181 | GfcAfaAfgGfcGfuGfcCfaAfcUfcAf(invdT) | 188 | pdTsdGaGfuUfgGfcAfcGfcCfuUfuGfc(invdT) | 0.631 |
| 181 | GfcAfaAfgGfcGfuGfcCfaAfcUfcAf(invdT) | 189 | pdTsGfaGfuUfgGfcAfcGfcCfuUfuGfc(invdT) | 0.702 |
| 181 | GfcAfaAfgGfcGfuGfcCfaAfcUfcAf(invdT) | 190 | pusGfaGfuUfgGfcAfcGfcCfuUfuGfc(invdT) | 0.749 |
| 181 | GfcAfaAfgGfcGfuGfcCfaAfcUfcAf(invdT) | 166 | puGfaGfuUfgGfcAfcGfcCfuUfuGfc(invdT) | 1.002 |
| 181 | GfcAfaAfgGfcGfuGfcCfaAfcUfcAf(invdT) | 191 | psUfGfaGfuUfgGfcAfcGfcCfuUfuGfc(invdT) | 1.185 |
| 181 | GfcAfaAfgGfcGfuGfcCfaAfcUfcAf(invdT) | 192 | UfsGfaGfuUfgGfcAfcGfcCfuUfuGfc(invdT) | 2.257 |
| 181 | GfcAfaAfgGfcGfuGfcCfaAfcUfcAf(invdT) | 193 | psUfsGfaGfuUfgGfcAfcGfcCfuUfuGfc(invdT) | 2.428 |
| 181 | GfcAfaAfgGfcGfuGfcCfaAfcUfcAf(invdT) | 194 | psdTsdGaGfuUfgGfcAfcGfcCfuUfuGfc(invdT) | 3.208 |
| 181 | GfcAfaAfgGfcGfuGfcCfaAfcUfcAf(invdT) | 195 | usGfaGfuUfgGfcAfcGfcCfuUfuGfc(invdT) | 3.974 |
| 181 | GfcAfaAfgGfcGfuGfcCfaAfcUfcAf(invdT) | 196 | uGfaGfuUfgGfcAfcGfcCfuUfuGfc(invdT) | 4.235 |
| 181 | GfcAfaAfgGfcGfuGfcCfaAfcUfcAf(invdT) | 197 | dTsGfaGfuUfgGfcAfcGfcCfuUfuGfc(invdT) | 4.235 |
| 181 | GfcAfaAfgGfcGfuGfcCfaAfcUfcAf(invdT) | 198 | psdTGfaGfuUfgGfcAfcGfcCfuUfuGfc(invdT) | 4.704 |
| 181 | GfcAfaAfgGfcGfuGfcCfaAfcUfcAf(invdT) | 199 | dTsdGaGfuUfgGfcAfcGfcCfuUfuGfc(invdT) | 5.341 |
| 183 | (Chol)GfcAfaAfgGfcGfuGfcCfaAfcUfcAf(invdT) | 190 | pusGfaGfuUfgGfcAfcGfcCfuUfuGfc(invdT) | 9.771 |

The ratio of 5'-phosphorylation is calculated for each strand of a siRNA from the UV trace at 260 nm using the following equitation (PA is peak area):

$$\%_{(5'\text{-phosphorylation})} = 100 * PA_{[5'\text{-phosphorylated strand}]} / (PA_{[5'\text{-phosphorylated strand}]} + PA_{[parent strand]})$$

two siRNAs, that were comparably active in the in vitro assay as the parental SEQ ID NO pair 182/168 (SEQ ID NO pair 181/186 and 181/185), are susceptible to 5'-phosphorylation once the synthetically introduced 5'-phosphate/5'-PTO group is cleaved in vivo, eg. by phosphatases.

TABLE 8

Percentage of 5'-phosphorylated strand after 4 hours incubation in S100 HeLa cell extract.

| SEQ ID NO | Sense strand sequence (5'-3') | sense 5'P [%] | SEQ ID NO | Antisense strand sequence (5'-3') | antisense 5'P [%] |
|---|---|---|---|---|---|
| 181 | GfcAfaAfgGfcGfuGfcCfaAfcUfcAf(invdT) | 52 | 196 | uGfaGfuUfgGfcAfcGfcCfuUfuGfc(invdT) | 0 |
| 181 | GfcAfaAfgGfcGfuGfcCfaAfcUfcAf(invdT) | 53 | 195 | usGfaGfuUfgGfcAfcGfcCfuUfuGfc(invdT) | 0 |

TABLE 8-continued

Percentage of 5'-phosphorylated strand after 4 hours incubation in S100 HeLa cell extract.

| SEQ ID NO | Sense strand sequence (5'-3') | sense 5'P [%] | SEQ ID NO | Antisense strand sequence (5'-3') | antisense 5'P [%] |
|---|---|---|---|---|---|
| 181 | GfcAfaAfgGfcGfuGfcCfaAfcUfcAf(invdT) | 44 | 192 | UfsGfaGfuUfgGfcAfcGfcCfuUfuGfc(invdT) | 22 |
| 181 | GfcAfaAfgGfcGfuGfcCfaAfcUfcAf(invdT) | 42 | 197 | dTsGfaGfuUfgGfcAfcGfcCfuUfuGfc(invdT) | 22 |
| 181 | GfcAfaAfgGfcGfuGfcCfaAfcUfcAf(invdT) | 47 | 199 | dTsdGaGfuUfgGfcAfcGfcCfuUfuGfc(invdT) | 13 |
| 182 | GcAAAGGcGuGccAAcucAdTsdT | 31 | 168 | UGAGUUGGcACGCCUUUGCdTsdT | 42 |
| 184 | GfcAfaAfgGfcGfuGfcCfaAfcUfcA | 22 | 168 | UGAGUUGGcACGCCUUUGCdTsdT | 100 |

Key: lower case letters a, c, g, u, are 2'-O-Methyl nucleotides; Upper case letters A, C, G, U followed by "f" indicates a 2'-fluoro nucleotide.(invdT) represents an inverted deoxythimidine (3'-3'-linked). A phosphorothioate linkages is symbolized with a lower case "s". dT is deoxythimidine.

Example 46

In Vitro DNAse II-Stability of siRNAs with Optimized 5' Ends

All antisense strands were screened for DNAse II stability as described in example 41. The two antisense strands present in the siRNAs that were comparable active to the parental duplex (SEQ ID NO 186 and SEQ ID NO pair 185 one with a 5'-terminal 2'-F and a phosphate group and one with two 5'-terminal 2'-deoxy nucleotides and a 5'-phosphorthioate are stable towards DNAse II cleavage II (>70% intact strand after 20 hr incubation).

Example 47

In Vivo Knock Down Activity of siRNAs with Optimized 5' Ends

In order to evaluate if the in vitro improvement by optimized 5'-ends transfers to the in vivo situation, we conducted further mouse experiments with GalNAc-palmitoyl conjugates of selected siRNAs (see Table 10). SiRNAs were administered as under identical conditions as described for the first mouse experiment (example 42, this patent application). For measurement of FVII levels, plasma samples from mice were prepared by collecting blood (9 volumes) by submandibular bleeding into microcentrifuge tubes containing

TABLE 9

In vitro stability of siRNAs towards DNase II after 20 hours incubation

| Sense SEQ ID NO | Antisense SEQ ID NO | Sequence (5'-3') | % intact strand |
|---|---|---|---|
| 181 | 192 | UfsGfaGfuUfgGfcAfcGfcCfuUfuGfc(invdT) | 11 |
| 181 | 197 | dTsGfaGfuUfgGfcAfcGfcCfuUfuGfc(invdT) | 0 |
| 181 | 199 | dTsdGaGfuUfgGfcAfcGfcCfuUfuGfc(invdT) | 0 |
| 181 | 193 | psUfsGfaGfuUfgGfcAfcGfcCfuUfuGfc(invdT) | 106 |
| 181 | 187 | psdTsGfaGfuUfgGfcAfcGfcCfuUfuGfc(invdT) | 96 |
| 181 | 194 | psdTsdGaGfuUfgGfcAfcGfcCfuUfuGfc(invdT) | 101 |
| 181 | 191 | psUfGfaGfuUfgGfcAfcGfcCfuUfuGfc(invdT) | 100 |
| 181 | 198 | psdTGfaGfuUfgGfcAfcGfcCfuUfuGfc(invdT) | 95 |
| 181 | 186 | psdTdGaGfuUfgGfcAfcGfcCfuUfuGfc(invdT) | 99 |
| 181 | 185 | pUfsGfaGfuUfgGfcAfcGfcCfuUfuGfc(invdT) | 71 |
| 181 | 189 | pdTsGfaGfuUfgGfcAfcGfcCfuUfuGfc(invdT) | 74 |
| 181 | 188 | pdTsdGaGfuUfgGfcAfcGfcCfuUfuGfc(invdT) | 64 |

0.109 mol/L sodium citrate anticoagulant (1 volume) following standard procedures. FVII activity in plasma was measured with a chromogenic method using a BIOPHEN VII kit (Hyphen BioMed/Aniara, Mason, Ohio) following manufacturer's recommendations. Absorbance of colorimetric development was measured using a Tecan Safire2 microplate reader at 405 nm.

The siRNAs under investigation showed improved in vivo activity, fully correlating with the in vitro screening results. FVII activity in serum was reduced by more than 80% for both siRNAs 48 hours post dosing, compared to 49% using the first generation siRNA design (see Table 10). This result clearly underscores the importance of a 5'-terminal nucleotide on the antisense strand that can be effectively phosphorylated, in case phosphatases in vivo cleave the synthetically generated 5'-phosphate or 5'-phosphothioate group. In case of a 5'-terminal 2'-OMe nucleotide as used in the initial design or described in the literature as a more potent siRNA design based on in vitro comparison with canonical siRNAs (Allerson et al. J. Med Chem. 2005, 48, 901-904), the cleavage of the synthetic phosphate in vivo would lead to a strong reduction in potency of the corresponding siRNA.

TABLE 10

In vivo knockdown activity of siRNAs with optimized 5'ends.

| SEQ ID NO | Sense strand sequence (5'-3') | SEQ ID NO | Antisense strand sequence (5'-3') | % remaining FVII in serum |
|---|---|---|---|---|
| 179 | GalNAc-(NHC6)-GfcAfaAfgGfcGfuGfcCfaAfcUfcAf(invdT) | 166 | puGfaGfuUfgGfcAfcGfcCfuUfuGfc(invdT) | 27 |
| 179 | GalNAc-(NHC6)-GfcAfaAfgGfcGfuGfcCfaAfcUfcAf(invdT) | 190 | pusGfaGfuUfgGfcAfcGfcCfuUfuGfc(invdT) | 51 |
| 179 | GalNAc-(NHC6)-GfcAfaAfgGfcGfuGfcCfaAfcUfcAf(invdT) | 185 | pUfsGfaGfuUfgGfcAfcGfcCfuUfuGfc(invdT) | 17 |
| 179 | GalNAc-(NHC6)-GfcAfaAfgGfcGfuGfcCfaAfcUfcAf(invdT) | 263 | psdTdGfaGfuUfgGfcAfcGfcCfuUfuGfc(invdT) | 13 |

Key: lower case letters a, c, g, u, are 2'-O-Methyl nucleotides; Upper case letters A, C, G, U followed by "f" indicates a 2'-fluoro nucleotide. Lower case "p" indicates a 5'-phosphate. (invdT) represents an inverted deoxythimidine (3'-3'-linked). A phosphorothioate linkages is symbolized with a lower case "s".(NHC6) is the aminohexyl linker incorporated at the 5'-end of the sense strand. GalNAc refers to the structure in formula (IV).

Example 48

In Vitro Knock Down Activity of siRNAs with Optimized 3' Ends

To further increase activity of the DNase II stable siRNAs an SAR study of the 3'-overhang was performed. Various combinations of invdT, dTinvdT or dTsdT on either the sense or the antisense strand 3'-overhang were applied to Aha1- and EGFP-targeting siRNAs (see Tables 11 and 12, respectively) and were pair wise compared for composition of both 3'ends in most potent siRNAs. All siRNAs were screened in dose response (24 nM to 0.00037 nM in 4-fold dilutions) for knock down activity after transfection of primary mouse hepatocytes (30000 cells/well; 96 well plate format) using Lipofectamine2000 according to the manufacturer's instructions.

TABLE 11

In vitro knock down activity of EGFP-targeting siRNAs with different 3'-ends.

| SEQ ID NO | Sense strand sequence (5'-3') | SEQ ID NO | Antisense strand sequence (5'-3') | IC50 (nM |
|---|---|---|---|---|
| 45 | GCUGGAGUUCGUGACCGCCdTdT | 46 | GGCGGUCACGAACUCCAGCdTdT | 1.0490 |
| 212 | GcuGGAGuucGuGAccGccdTsdT | 225 | GGCGGUcACGAACUCcAGCdTsdT | #N/A |
| 201 | gcUfgGfaGfuUfcGfuGfaCfcGfcCf(invdT) | 221 | dGsGfcGfgUfcAfcGfaAfcUfcCfaGfc(invdT) | 0.4377 |
| 201 | gcUfgGfaGfuUfcGfuGfaCfcGfcCf(invdT) | 214 | dGsGfcGfgUfcAfcGfaAfcUfcCfaGfcdTsdT | 0.1479 |

TABLE 11-continued

In vitro knock down activity of EGFP-targeting siRNAs with different 3'-ends.

| SEQ ID NO | Sense strand sequence (5'-3') | SEQ ID NO | Antisense strand sequence (5'-3') | IC50 (nM |
|---|---|---|---|---|
| 211 | gcUfgGfaGfuUfcGfuGfaCfcGfcCfdT(invdT) | 223 | dGsGfcGfgUfcAfcGfaAfcUfcCfaGfcdT | 0.5833 |
| 203 | gcUfgGfaGfuUfcGfuGfaCfcGfcCfdTsdT | 214 | dGsGfcGfgUfcAfcGfaAfcUfcCfaGfcdTsdT | 0.2166 |
| 204 | GfcUfgGfaGfuUfcGfuGfaCfcGfcCf(invdT) | 224 | pGfsGfcGfgUfcAfcGfaAfcUfcCfaGfc(invdT) | 0.9100 |
| 204 | GfcUfgGfaGfuUfcGfuGfaCfcGfcCf(invdT) | 215 | pGfsGfcGfgUfcAfcGfaAfcUfcCfaGfcdTsdT | 0.2241 |
| 207 | GfcUfgGfaGfuUfcGfuGfaCfcGfcCfdT(invdT) | 218 | pGfsGfcGfgUfcAfcGfaAfcUfcCfaGfcdT(invdT) | 0.3474 |
| 206 | GfcUfgGfaGfuUfcGfuGfaCfcGfcCfdTsdT | 215 | pGfsGfcGfgUfcAfcGfaAfcUfcCfaGfcdTsdT | 0.2392 |
| 205 | GfscUfgGfaGfuUfcGfuGfaCfcGfcCf(invdT) | 220 | GfsGfcGfgUfcAfcGfaAfcUfcCfaGfc(invdT) | 0.4251 |
| 205 | GfscUfgGfaGfuUfcGfuGfaCfcGfcCf(invdT) | 216 | GfsGfcGfgUfcAfcGfaAfcUfcCfaGfcdTsdT | 0.2349 |
| 210 | GfscUfgGfaGfuUfcGfuGfaCfcGfcCfdT(invdT) | 222 | GfsGfcGfgUfcAfcGfaAfcUfcCfaGfcdT(invdT) | 0.5230 |
| 209 | GfscUfgGfaGfuUfcGfuGfaCfcGfcCfdTsdT | 216 | GfsGfcGfgUfcAfcGfaAfcUfcCfaGfcdTsdT | 0.4937 |
| 200 | gscUfgGfaGfuUfcGfuGfaCfcGfcCf(invdT) | 217 | pdGsGfcGfgUfcAfcGfaAfcUfcCfaGfc(invdT) | 0.2643 |
| 200 | gscUfgGfaGfuUfcGfuGfaCfcGfcCf(invdT) | 213 | pdGsGfcGfgUfcAfcGfaAfcUfcCfaGfcdTsdT | 0.0936 |
| 208 | gscUfgGfaGfuUfcGfuGfaCfcGfcCfdT(invdT) | 219 | pdGsGfcGfgUfcAfcGfaAfcUfcCfaGfcdT(invdT) | 0.3776 |
| 202 | gscUfgGfaGfuUfcGfuGfaCfcGfcCfdTsdT | 213 | pdGsGfcGfgUfcAfcGfaAfcUfcCfaGfcdTsdT | 0.1569 |

TABLE 12

In vitro knock down activity of Aha1-targeting siRNAs with different 3'-ends.

| SEQ ID NO | Sense strand sequence (5'-3') | SEQ ID NO | Antisense strand sequence (5'-3') | IC50 (nM |
|---|---|---|---|---|
| 157 | GGAuGAAGuGGAGAuuAGudTsdT | 158 | ACuAAUCUCcACUUcAUCCdTsdT | 0.094 |
| 234 | GfgAfuGfaAfgUfgGfaGfaUfuAfgUf(invdT) | 246 | AfsCfuAfaUfcUfcCfaCfuUfcAfuCfc(invdT) | 0.081 |
| 234 | GfgAfuGfaAfgUfgGfaGfaUfuAfgUf(invdT) | 240 | AfsCfuAfaUfcUfcCfaCfuUfcAfuCfcdTsdT | 0.036 |
| 233 | GfgAfuGfaAfgUfgGfaGfaUfuAfgUfdT(invdT) | 239 | AfsCfuAfaUfcUfcCfaCfuUfcAfuCfcdT(invdT) | 0.034 |
| 236 | GfgAfuGfaAfgUfgGfaGfaUfuAfgUfdTsdT | 240 | AfsCfuAfaUfcUfcCfaCfuUfcAfuCfcdTsdT | 0.040 |
| 231 | GfsgAfuGfaAfgUfgGfaGfaUfuAfgUf(invdT) | 241 | pAfsCfuAfaUfcUfcCfaCfuUfcAfuCfc(invdT) | 0.037 |
| 231 | GfsgAfuGfaAfgUfgGfaGfaUfuAfgUf(invdT) | 267 | pAfsCfuAfaUfcUfcCfaCfuUfcAfuCfcdTsdT | 0.030 |
| 229 | GfsgAfuGfaAfgUfgGfaGfaUfuAfgUfdT(invdT) | 268 | pAfsCfuAfaUfcUfcCfaCfuUfcAfuCfcdT(invdT) | 0.024 |
| 228 | GfsfAfuGfaAfgUfgGfaGfaUfuAfgUf(invdT) | 267 | pAfsCfuAfaUfcUfcCfaCfuUfcAfuCfcdTsdT | 0.021 |
| 232 | ggAfuGfaAfgUfgGfaGfaUfuAfgUf(invdT) | 245 | dAsCfuAfaUfcUfcCfaCfuUfcAfuCfc(invdT) | 0.060 |
| 232 | ggAfuGfaAfgUfgGfaGfaUfuAfgUf(invdT) | 238 | dAsCfuAfaUfcUfcCfaCfuUfcAfuCfcdTsdT | 0.030 |
| 237 | ggAfuGfaAfgUfgGfaGfaUfuAfgUfdT(invdT) | 244 | dAsCfuAfaUfcUfcCfaCfuUfcAfuCfcdT(invdT) | 0.045 |
| 230 | ggAfuGfaAfgUfgGfaGfaUfuAfgUfdTsdT | 238 | dAsCfuAfaUfcUfcCfaCfuUfcAfuCfcdTsdT | 0.025 |
| 227 | gsgAfuGfaAfgUfgGfaGfaUfuAfgUf(invdT) | 243 | pdAsCfuAfaUfcUfcCfaCfuUfcAfuCfc(invdT) | 0.045 |
| 227 | gsgAfuGfaAfgUfgGfaGfaUfuAfgUf(invdT) | 266 | pdAsCfuAfaUfcUfcCfaCfuUfcAfuCfcdTsdT | 0.015 |
| 235 | gsgAfuGfaAfgUfgGfaGfaUfuAfgUfdT(invdT) | 242 | pdAsCfuAfaUfcUfcCfaCfuUfcAfuCfcdT(invdT) | 0.039 |
| 226 | gsgAfuGfaAfgUfgGfaGfaUfuAfgUfdTsdT | 266 | pdAsCfuAfaUfcUfcCfaCfuUfcAfuCfcdTsdT | 0.014 |

It was found, that siRNAs with 2 nucleotide dTsdT-overhangs on the antisense strand performed always better than those with a single invdT overhang at the antisense's 3'-end (while sense strands were the same). Further beneficial was the combination with a sense strand modified with a single invdT-overhang as 3' overhang.

Example 49

In Vivo Knock Down Activity of siRNAs in Non-Human Primates

Preparation of DPCs and Dosing

DPCs were prepared by covalently attaching polymer "149 RAFT" to the indicated siRNA targeting coagulation Factor VII (siF7) at 4:1 wt:wt ratio (polymer:siRNA) through a disulfide linkage and then modifying the polymer-siRNA conjugate with a 2:1 wt:wt mixture of CDM-PEG:CDM-NAG at a 7×wt:wt ratio (CDM:polymer). Cynomolgous monkeys were dosed with 1 mg/kg DPC (polymer weight) and 0.25 mg/kg of the indicated siRNA. One animal received DPC containing siF7 SEQ ID NO pair 151/152, two animals received DPC containing siF7 SEQ ID NO pair 253/254), #1 and #2), and two animals received DPC containing SEQ ID NO pair 251/255, #1 and #2). F7 values were normalized to the average of the two pre-dose values. Animals receiving DPCs containing SEQ ID NO pair 253/254 or SEQ ID NO pair 251/255 had greater levels of F7 knockdown and longer PT than the animal receiving SEQ ID NO pair 251/252.

DPC Injection Procedure

For each injection procedure, animals were given an IM injection containing a combination of ketamine (up to 7 mg/kg) and dexmedetomidine (up to 0.03 mg/kg) and moved to a procedure room. In the procedure room, animals were placed on a water jacketed heating pad and the injection site was shaved and prepped with an antiseptic. An intravenous catheter (20 to 22 gauge) was inserted into a systemic vein (cephalic or small saphenous) and the DPC solution was infused (2 ml/kg) slowly over 1 to 2 minutes. A pulse oximeter was used to monitor the heart rate and oxygen saturation during and immediately following the injection procedure. Each injection procedure took about 20 minutes to perform. After injection the catheter was removed and gentle pressure was applied to the venipuncture site. Animals were taken back to their cages and given an IM injection of the reversal drug atipamezole (antisedan) (0.10 to 0.15 mg/kg). Animals were monitored until they regained normal activity.

Blood Collection Procedure

Blood samples (1-5 ml) were obtained for the measurement of gene inhibition (F7 activity, coagulation time), blood chemistries, and markers of liver damage (CBC, chemistry panel, ALT, cytokines, complement). For these blood collection procedures, animals were given an IM injection containing a combination of ketamine (up to 7 mg/kg) and dexmedetomidine (up to 0.03 mg/kg). Once sedated, animals were moved on to a portable procedure table and a 22 gauge needle and syringe were used to collect blood from the femoral vein. Immediately after the blood collection, pressure was applied to the venipuncture site and the blood was divided into the appropriate sample tubes for each blood test. Animals were then given an IM injection of the reversal drug atipamezole (antisedan) (0.10 to 0.15 mg/kg) and returned to their cage. No more than 20% of total blood volume was drawn in any 30-day period (estimated blood volume=60 ml/kg). Each blood collection procedure took about 10 minutes to perform.

Factor VII (F7) Activity Measurements

Blood samples from non-human primates were prepared by filling serum separator tubes with whole blood and allowing the blood to clot at room temperature for at least 20 minutes. After clotting, blood tubes were centrifuged for 3 minutes at 9000 rpm, aliquoted into eppendorf tubes, and stored at −20° C. until assayed. F7 activity in serum was measured with a chromogenic method using a BIOPHEN VII kit (Hyphen BioMed/Aniara, Mason, Ohio) following manufacturer's recommendations. Absorbance of colorimetric development was measured using a Tecan Safire2 microplate reader at 405 nm.

Coagulation Tests (Protime, Partial Protime and Fibrinogen)

Blood samples from non-human primates were prepared by completely filling sodium citrate tubes (BD Vacutainer) with whole blood and gently mixing to prevent clot formation. Tubes were transported to a clinical testing lab within one hour and coagulation assays were performed within 4 hours from the time of collection.

TABLE 13

FVII dsRNAs used for NHP experiment:

| SEQ ID NO | Sense strand sequence (5'-3') | SEQ ID NO | Antisense strand sequence (5'-3') |
|---|---|---|---|
| 251 | (NH2C6)GfuUfgGfuGfaAfuGfgAfgCfuCf aGf(invdT) | 252 | pCfsUfgAfgCfuCfcAfuUfcAfcCfaAfc (invdT) |
| 253 | (NH2C6)GfgUfcCfuGfuUfgUfuGfgUfgAf aUf(invdT) | 254 | pAfsUfuCfaCfcAfaCfaAfcAfgGfaCfcd TsdT |
| 251 | (NH2C6)GfuUfgGfuGfaAfuGfgAfgCfuCf aGf(invdT) | 255 | pCfsUfgAfgCfuCfcAfuUfcAfcCfaAfcd TsdT |

Key: lower case letters a, c, g, u, are 2'-O-Methyl nucleotides; Upper case letters A, C, G, U followed by "f" indicates a 2'-fluoro nucleotide. Lower case "p" indicates a 5'-phosphate. (invdT) represents an inverted deoxythimidine (3'-3'-linked). A phosphorothioate linkages is symbolized with a lower case "s". dT is deoxythimidine. NH2C6 is the aminohexyl inker incorporated at the 5'-end of the sense strand.

Changing from an single nucleotide (invdT)-3'-overhang on both strands to an asymmetric siRNA design with a 3'-(invdT) overhang on the sense strand and a dTsdT overhang on the antisense strand, but otherwise constant modification pattern lead to a more pronounced serum FVII reduction and a significantly prolonged duration of this effect in non-human primates (see FIG. 6a). This observation is supported by an expected biologic consequence, namely a more pronounced effect on the prothrombin time corresponding to the extent of Factor 7 reduction (see FIG. 6b).

Example 50

In Vivo Knock Down Activity of siRNAs with Cleavable RNA Linkers

In Table 14 the in vivo efficacy based on FVII protein inhibition in serum was compared using cholesterol or the GalNAc-palmitoyl siRNA conjugate in the same sequence context in mice. The in vivo experiment was conducted as described in example 42. FVII inhibition was strongly decreased for the cholesterol conjugated siRNAs containing no 2'-OH nucleotide compared to the GalNAc-palmitoyl conjugated counterparts (SEQ ID NO pair 179/166 vs. 179/190, SEQ ID NO pair 257/264 vs. SEQ ID NO pair 179/262, SEQ ID NO pair 257/263 vs. SEQ ID NO pair 179/163 and SEQ ID NO pair 257/166 vs. (SEQ ID NO pair 179/166). In contrast for a 2'-OH containing siRNA the cholesterol conjugate lead to higher FVII inhibition compared to the GalNAc-palmitoyl derivative (SEQ ID NO pair 180/168 vs. SEQ ID NO pair 258/168).

The small molecule ligands GalNAc-palmitoyl and cholesterol used in the described in vivo experiment are connected to the siRNA via a non-cleavable linker to the 5'-end of the sense strand. In case the sense strand exhibit 2'-OH nucleotides the ligand is still cleavable by nucleases (e.g. DNase II in the endosomal or lysosomal compartment). The cleavage reaction releases the free siRNA that is then released into the cytoplasm by the endosomal perturbing activity of the delivery polymer.

For siRNAs lacking a 2'-OH nucleotide in the sense strand, the ligands are stably connected to the duplex, as no enzymatic (nuclease/protease/esterase etc.) or chemical mechanism triggers the cleavage of the ligand. Therefore, fully stable cholesterol conjugated siRNA can be trapped in cell membranes due to the membrane interaction of the lipophilic cholesterol ligand. Even high concentrations of the siRNA in the tissue is not sufficient for effective release of the siRNA into in the cytoplasm. In contrast, the less lipophilic GalNAc-palmitoyl conjugated siRNA can be released into the cytoplasm, due to a less pronounced interaction with cell membranes. For this reason a stable, non-cleavable GalNAc-palmitoyl siRNA conjugate is more efficacious compared to cholesterol conjugated to the same siRNA.

Developing cleavable linker constructs would help to circumvent the issue of membrane trapping of stably cholesterol conjugated siRNA. Using disulfide linker chemistry is described as an attractive possibility to introduce a defined cleavage site. However, cleavage is restricted to reducing organelles within the cell (PNAS, 2006, 103, 13872). As cleavage is expected to be slow in the endosomal/lysosomal compartment most of the cholesterol-disulfide conjugated siRNA can still be trapped in membranes as described for the non-cleavable cholesterol conjugates.

In addition to the well-established disulfide cleavable linker chemistry another possibility is the generation of defined cleavage sites by using 2'-OH nucleotides at certain positions. Introduction of 2'-OH nucleotides at selective positions is a new approach to achieve cleavage of the conjugates from RNA strands. The 2'-OH nucleotides can either be implemented by adding single stranded overhangs with at least one 2'-OH-nucleotide at the 3'- or 5'-end of the RNA strand or by using 2'-OH nucleotides within the duplex region of an siRNA. The enzymatic activity of nucleases present in the endosome/lysosome cleaves selectively at these positions. In a first design the cholesterol was connected to the

TABLE 14

| Conjugate | SEQ ID NO pair | SEQ ID NO | Sequence 5'->3' | % FVII activity in serum |
|---|---|---|---|---|
| GalNAc | 179/166 | 179 | GalNAc-NHC6-GfcAfaAfgGfcGfuGfcCfaAfcUfcAf(invdT) | 27 |
| | | 166 | puGfaGfuUfgGfcAfcGfcCfuUfuGfc(invdT) | |
| | 179/190 | 179 | GalNAc-NHC6-GfcAfaAfgGfcGfuGfcCfaAfcUfcAf(invdT) | 51 |
| | | 190 | pusGfaGfuUfgGfcAfcGfcCfuUfuGfc(invdT) | |
| | 179/262 | 179 | GalNAc-NHC6-GfcAfaAfgGfcGfuGfcCfaAfcUfcAf(invdT) | 17 |
| | | 262 | pUfsGfaGfuUfgGfcAfcGfcCfuUfuGfc(invdT) | |
| | 179/263 | 179 | GalNAc-NHC6-GfcAfaAfgGfcGfuGfcCfaAfcUfcAf(invdT) | 13 |
| | | 263 | psdTdGfaGfuUfgGfcAfcGfcCfuUfuGfc(invdT) | |
| | 180/168 | 180 | GalNAc-NHC6-GcAAAGGcGuGccAAcucAdTsdT | 86 |
| | | 168 | UGAGUUGGcACGCCUUUGCdTsdT | |
| Cholesterol | 257/166 | 257 | Chol-pGfcAfaAfgGfcGfuGfcCfaAfcUfcAf(invdT) | 48 |
| | | 166 | puGfaGfuUfgGfcAfcGfcCfuUfuGfc(invdT) | |
| | 257/190 | 257 | Chol-pGfcAfaAfgGfcGfuGfcCfaAfcUfcAf(invdT) | 93 |
| | | 190 | pusGfaGfuUfgGfcAfcGfcCfuUfuGfc(invdT) | |
| | 257/264 | 257 | Chol-pGfcAfaAfgGfcGfuGfcCfaAfcUfcAf(invdT) | 63 |
| | | 264 | pUfsGfaGfuUfgGfcAfcGfcCfuUfuGfc(invdT) | |
| | 257/263 | 257 | Chol-pGfcAfaAfgGfcGfuGfcCfaAfcUfcAf(invdT) | 41 |
| | | 263 | psdTdGfaGfuUfgGfcAfcGfcCfuUfuGfc(invdT) | |
| | 258/168 | 258 | Chol-pGcAAAGGcGuGccAAcucAdTsdT | 50 |
| | | 168 | UGAGUUGGcACGCCUUUGCdTsdT | | sense strand via a single stranded overhang containing 3 2'-OH nucleotides (AUC) at the 5'-terminus.

Cholesterol conjugated siRNAs comparing various cleavable linker chemistries are shown in Table 15. All siRNAs have the identical sequence context, just the linker chemistry was altered. Cholesterol was connected to the sense strand via single stranded overhang comprised of a three 2'-OH nucleotides (AUC) to the 5'-terminus. When co-administered with a delivery polymer this siRNA (SEQ ID NO pair 260/263) lead to 77% FVII down modulation in serum in mice, compared to only 60% when using the identical siRNA with a stably attached cholesterol (SEQ ID NO pair 257/263). The same siRNA with a cholesterol conjugated via a linker according to formula Ia to the 5'-terminus of the sense strand (SEQ ID NO pair 261/263) lead to 93% FVII activity reduction in serum. All results were achieved by co-administration of 15 mg/kg of a delivery polymer with 2.5 mg/kg of the cholesterol conjugated siRNA in mice.

These results indicate, that the use of a cleavable linker improves the in vivo potency of siRNAs containing no 2'-OH nucleotide. The cleavable linker can either comprised of 2'-OH containing nucleotides, a di-peptide cleavage motive or a disulfide linker chemistry. All cleavable linker constructs improve the in vivo potency in a co-administration setup of a cholesterol conjugated siRNAs with a slow endosomal release delivery polymer.

connected to a UV detector at 260 nm. AEX-HPLC was performed on a Dionex DNA Pac200 column (4×250 mm) at 75° C. using a 20 mM Tris buffer containing 50% ACN at pH=8. 800 mM NaBr in eluent B serves as eluent salt. A gradient from 25 to 62% B in 18 minutes was employed.

The cholesterol containing single stranded RNA elutes from the HPLC column as a broad peak at 260 nm. After cleavage of the cholesterol sharp symmetric peaks is observed at lower retention time. Cleavage rate of cholesterol was determined by the following equitation (PA=Peak Area):

$$\%_{(free\ RNA)} = 100 * PA_{[free\ RNA]} / (PA_{[free\ RNA]} + PA_{[cholesterol\ conjugated\ RNA]})$$

In vitro it was shown, that the 3 nt nucleotide (AUC)-overhang is quantitatively cleaved in less than 1 hour in 90% mouse serum. The cleavage occurs 3' to the two pyrimidine nucleotides in the overhang, leading to two distinct cleavage metabolites (peak areas of metabolites were summarized for data evaluation). In contrast, the di-peptide containing linker according to formula 1a, the disulfide and the stably linked cholesterol are fully stable in mouse serum.

Example 52

Tissue Distribution of siRNAs with Cleavable Linkers

These results indicate, that the use of a cleavable linker improves the in vivo potency of siRNAs containing no 2'-OH

TABLE 15

In vivo comparison of various linker chemistries for cholesterol conjugated siRNAs

| SEQ ID NO | Sense strand sequence (5'-3') | SEQ ID NO | Antisense strand sequence (5'-3') | % FVII activity in serum |
|---|---|---|---|---|
| 257 | Chol-pGfcAfaAfgGfcGfuGfcCfaAfcUfcAf(invdT) | 263 | psdTdGfaGfuUfgGfcAfcGfcCfuUfuGfc(invdT) | 40 |
| 259 | Chol-C6SSC6-GfcAfaAfgGfcGfuGfcCfaAfcUfcAf(invdT) | 263 | psdTdGfaGfuUfgGfcAfcGfcCfuUfuGfc(invdT) | 22 |
| 260 | Chol-AUC-GfcAfaAfgGfcGfuGfcCfaAfcUfcAf(invdT) | 263 | psdTdGfaGfuUfgGfcAfcGfcCfuUfuGfc(invdT) | 23 |
| 261 | Chol-Cathepsin-(NHC6)-pGfcAfaAfgGfcGfuGfcCfaAfeUfcAf(invdT) | 263 | psdTdGfaGfuUfgGfcAfcGfcCfuUfuGfc(invdT) | 7 |

Example 51

In Vitro Serum Stability of siRNAs with Cleavable Linkers

The stability of the cleavable linker was evaluated in an in vitro stability assay. The cholesterol conjugated sense strands were incubated in 90% mouse serum at 37° C. for various time points. The incubation reaction was stopped by addition of proteinase K in a sodium dodecyl sulfate (SDS) containing buffer—The treatment degrades all proteins and enzymes without interfering with the RNA strand integrity. 25 µL of this solution was directly injected onto a AEX-HPLC system nucleotide. The cleavable linker can either comprised of 2'-OH containing nucleotides, a di-peptide cleavage motive or a disulfide linker chemistry. All cleavable linker constructs improve the in vivo potency in a co-administration setup of a cholesterol conjugated siRNAs with a slow endosomal release delivery polymer.

Briefly, the siRNA quantification is based on the hybridization of a fluorescently (Atto-425) labeled PNA-probe (Atto425-OO-TGAGTTGGCACGCCTTT ID NO: 269) obtained from Panagene Inc, Korea) complementary to the sense strand of the siRNA duplex, followed by AEX-HPLC based separation. Quantification was done by fluorescence detection against an external calibration curve that was generated from a dilution series of the two FVII siRNA used in the in vivo experiment (see example 42). For plasma samples between 0.2 to 2 µL and for tissue ~1 mg aliquots were injected onto the HPLC system.

In Table 16 results from liver tissue analysis are shown. When analyzing the siRNA content it was found, that the sense strand that is present in liver tissue, is quantitatively cleaved from cholesterol when using either the di-peptide linker motive or the 3 nt 5'-overhang with the unmodified linker sequence AUC. In contrast, only 15% of the disulfide linked siRNA that is present in the liver is cleaved from cholesterol within the first 48 hours post dosing and nothing of the stably attached cholesterol is cleaved from the siRNA.

When comparing the absolute amounts of cholesterol-free siRNA in liver tissue similar amounts were found for the disulfide linker and for the RNA AUC-linker, nicely correlating with equal FVII serum activity 48 hours post dosing The lower FVII activity achieved with the di-peptide linked cholesterol siRNA fully correlates with the higher absolute amount of the cleaved cholesterol-free siRNA.

The total amount of cholesterol siRNA conjugate equipped with an (AUC)-linker on the sense strand delivered into the liver is ~6-fold lower as compared to the stably or the disulfide attached cholesterol and ~3-fold lower compared to the di-peptide conjugated cholesterol siRNA. The reduced tissue presence can be attributed to the fact that the AUC-linker is not only a substrate for intracellular nucleases, but also for nucleases present in circulation as shown in the in vitro incubation with mouse serum. When the cholesterol ligand is cleaved from the siRNA already in circulation the resulting siRNA is prone to renal clearance and is rapidly excreted into urine without delivery into tissue.

Example 53

In Vivo Knock Down Activity of siRNAs with Cleavable RNA Linkers

The in vivo experiment was conducted as described in example 50 in mice using cholesterol siRNA conjugates. In example 50 the cholesterol was connected to the sense strand via a single stranded overhang containing 3 2'-OH nucleotides (AUC) at the 5'-terminus (SEQ ID NO pair 260/263), that showed low serum stability as described in example 51. This lead to a clearly reduced tissue concentration compared to serum stable linker chemistries as described in example 52. Combination of only one or two selected 2'-OH nucleotides together with 2'-OMe nucleotides within the linker lead to higher serum stability, but maintain sensitivity against nucleases present in the endosome/lysosome. The enzymatic activity of nucleases present in the endosome/lysosome cleaves selectively at the positions of the 2'-OH nucleotides.

The cholesterol conjugated siRNAs comparing various cleavable nucleotide linker motives are summarized in Table 17. All siRNAs have the identical sequence context, just the linker chemistry was altered. Cholesterol was connected to the 5'-terminus of the sense strand via single stranded overhang comprised of three or four nucleotides to the, with variable numbers of 2'-OH and 2'-OMe nucleotides. When co-administered with a delivery polymer all siRNAs lead to FVII down modulation in serum in mice. The siRNA (SEQ ID NO pair 276/282) lead to 87% FVII activity reduction in serum 48 hours and 95% 168 hours post dosing. The siRNA (SEQ ID NO pair 277/282) lead to 79% FVII activity reduction in serum 48 hours and 97% 168 hours post dosing. All results were achieved by co-administration of 15 mg/kg of a delivery polymer with 2.5 mg/kg of the cholesterol conjugated siRNA in mice.

TABLE 16

| SEQ ID NO | Sense strand sequence (5'-3') | SEQ ID NO | Antisense strand sequence (5'-3') | Total siRNA in Liver [ng/g] | % sense cleaved ligand in liver |
|---|---|---|---|---|---|
| 257 | Chol-pGfcAfaAfgGfcGfuGfcCfaAfcU fcAf(invdT) | 263 | psdTdGfaGfuUfgGfcAfcGfcCfuUfuGfc (invdT) | 5837 | 0 |
| 259 | Chol-C6SSC6-GfcAfaAfgGfcGfuGfcCfaAfcUf cAf(invdT) | 263 | psdTdGfaGfuUfgGfcAfcGfcCfuUfuGfc (invdT) | 4357 | 14.8 |
| 260 | Chol-AUC-GfcAfaAfgGfcGfuGfcCfaAfcUf cAf(invdT) | 263 | psdTdGfaGfuUfgGfcAfcGfcCfuUfuGfc (invdT) | 912 | 96.1 |
| 261 | Chol-Cathepsin-(NHC6)-pGfcAfaAfgGfcGfuGfcCfaAfeU fcAf(invdT) | 263 | psdTdGfaGfuUfgGfcAfcGfcCfuUfuGfc (invdT) | 2760 | 99.8 |

TABLE 17

In vivo comparison of various nucleotide linker motives for cholesterol conjugated siRNAs

| SEQ ID NO | Sense strand sequence (5'-3') | SEQ ID NO | Antisense strand sequence (5'-3') | % FVII activity in serum (48 and 168 hr p.d.) |
|---|---|---|---|---|
| 276 | Chol-uAu-GfcAfaAfgGfcGfuGfcCfaAfcUfcAf(invdT) | 282 | pdTsGfaGfuUfgGfcAfcGfcCfuUfuGf<u>c</u>dTsdT | 13 and 5 |
| 277 | Chol-uGu-GfcAfaAfgGfcGfuGfcCfaAfcUfcAf(invdT) | 282 | pdTsGfaGfuUfgGfcAfcGfcCfuUfuGf<u>c</u>dTsdT | 21 and 3 |
| 278 | Chol-uAuu-GfcAfaAfgGfcGfuGfcCfaAfcUfcAf(invdT) | 282 | pdTsGfaGfuUfgGfcAfcGfcCfuUfuGf<u>c</u>dTsdT | 19 and 9 |
| 279 | Chol-uGuu-GfcAfaAfgGfcGfuGfcCfaAfcUfcAf(invdT) | 282 | pdTsGfaGfuUfgGfcAfcGfcCfuUfuGf<u>c</u>dTsdT | 20 and 6 |
| 280 | Chol-uuAG-GfcAfaAfgGfcGfuGfcCfaAfcUfcAf(invdT) | 282 | pdTsGfaGfuUfgGfcAfcGfcCfuUfuGf<u>c</u>dTsdT | 46 and 18 |
| 281 | Chol-uAGu-GfcAfaAfgGfcGfuGfcCfaAfcUfcAf(invdT) | 282 | pdTsGfaGfuUfgGfcAfcGfcCfuUfuGf<u>c</u>dTsdT | 21 and 6 |

These results indicate, that the use of a nucleotide linker that are stable in serum and cleavable in endosome/lysosome further improve the in vivo potency of siRNAs compared to siRNAs with a serum labile linker. All cleavable linker constructs improve the in vivo potency in a co-administration setup of a cholesterol conjugated siRNAs with a slow endosomal release delivery polymer.

In the following tables siRNAs used in the examples are summarized:

TABLE 18

Core sequences

| SEQ ID NO | Sense strand sequence (5'-3') | SEQ ID NO | Antisense strand sequence (5'-3') |
|---|---|---|---|
| 1 | ACAUGAAGCAGCACGACUU | 2 | AAGUCGUGCUGCUUCAUGU |
| 3 | GCCCGACAACCACUACCUG | 4 | CAGGUAGUGGUUGUCGGGC |
| 5 | CGAGAAGCGCGAUCACAUG | 6 | CAUGUGAUCGCGCUUCUCG |
| 7 | AUAUCAUGGCCGACAAGCA | 8 | UGCUUGUCGGCCAUGAUAU |
| 9 | ACAAGCUGGAGUACAACUA | 10 | UAGUUGUACUCCAGCUUGU |
| 11 | GCAGCUCGCCGACCACUAC | 12 | GUAGUGGUCGGCGAGCUGC |
| 13 | CGUCCAGGAGCGCACCAUC | 14 | GAUGGUGCGCUCCUGGACG |
| 15 | GCUGGAGUUCGUGACCGCC | 16 | GGCGGUCACGAACUCCAGC |
| 17 | CCACCCUGACCUACGGCGU | 18 | ACGCCGUAGGUCAGGGUGG |
| 19 | CGACUUCAAGGAGGACGGC | 20 | GCCGUCCUCCUUGAAGUCG |
| 21 | UUCAAGAUCCGCCACAACA | 22 | UGUUGUGGCGGAUCUUGAA |
| 23 | GGCAACUACAAGACCCGCG | 24 | CGCGGGUCUUGUAGUUGCC |
| 25 | CCGGCAAGCUGCCCGUGCC | 26 | GGCACGGGCAGCUUGCCGG |
| 27 | UGCCCAUCCUGGUCGAGCU | 28 | AGCUCGACCAGGAUGGGCA |
| 29 | CAAGUUCAGCGUGUCCGGC | 30 | GCCGGACACGCUGAACUUG |
| 151 | GGAAUCUUAUAUUUGAUCCAA | 152 | UUGGAUCAAAUAUAAGAUUCCCU |
| 155 | GGAUGAAGUGGAGAUUAGU | 156 | ACUAAUCUCCACUUCAUCC |

TABLE 18-continued

Core sequences

| SEQ ID NO | Sense strand sequence (5'-3') | SEQ ID NO | Antisense strand sequence (5'-3') |
|---|---|---|---|
| 161 | GCAAAGGCGUGCCAACUCA | 162 | UGAGUUGGCACGCCUUUGC |
| 161 | GCAAAGGCGUGCCAACUCA | 178 | TGAGUUGGCACGCCUUUGC |
| 163 | GGAUCAUCUCAAGUCUUAC | 164 | GUAAGACUUGAGAUGAUCC |
| 171 | UGACCACAGUCGGAUUAAA | 172 | UUUAAUCCGACUGUGGUCA |
| 247 | GUUGGUGAAUGGAGCUCAG | 248 | CUGAGCUCCAUUCACCAAC |
| 249 | GGUCCUGUUGUUGGUGAAU | 250 | AUUCACCAACAACAGGACC |
| 256 | UAUGCAAAGGCGUGCCAACUCA | 178 | TGAGUUGGCACGCCUUUGC |
| 271 | UGUGCAAAGGCGUGCCAACUCA | 178 | TGAGUUGGCACGCCUUUGC |
| 272 | UAUUGCAAAGGCGUGCCAACUCA | 178 | TGAGUUGGCACGCCUUUGC |
| 273 | UGUUGCAAAGGCGUGCCAACUCA | 178 | TGAGUUGGCACGCCUUUGC |
| 274 | UUAGGCAAAGGCGUGCCAACUCA | 178 | TGAGUUGGCACGCCUUUGC |
| 275 | UAGUGCAAAGGCGUGCCAACUCA | 178 | TGAGUUGGCACGCCUUUGC |

TABLE 19

Mapping of core sequences and modified sequence

| Core sequences | | Modified sequences | |
|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |
|---|---|---|---|---|---|---|---|
| 1 | ACAUGAAGCAGCACGACUU | 2 | AAGUCGUGCUGCUUCAUGU | 31 | ACAUGAAGCAGCACGACUUdTdT | 32 | AAGUCGUGCUGCUUCAUGUdTdT |
| 1 | ACAUGAAGCAGCACGACUU | 2 | AAGUCGUGCUGCUUCAUGU | 61 | AfcAfuGfaAfgCfaGfcAfcGfaCfuUfdTsdT | 62 | paAfgUfcGfuGfcUfgCfuUfcAfuGfudTsdT |
| 1 | ACAUGAAGCAGCACGACUU | 2 | AAGUCGUGCUGCUUCAUGU | 91 | dAcdAudGadAgdCadGcdAcdGadCudTdTsdT | 92 | padAgdTcdGudGcdTgdCudTcdAudGudTsdT |
| 1 | ACAUGAAGCAGCACGACUU | 2 | AAGUCGUGCUGCUUCAUGU | 121 | AfdCAfdTGfdAAfdGCfdAGfdCAfdCGfdACfdTUfdTsdT | 122 | pdAAfdGUfdCGfdTGfdCUfdGCfdTUfdCAfdTGfdTdTsdT |
| 3 | GCCCGACAACCACUACCUG | 4 | CAGGUAGUGGUUGUCGGGC | 33 | GCCCGACAACCACUACCUGdTdT | 34 | CAGGUAGUGGUUGUCGGGCdTdT |
| 3 | GCCCGACAACCACUACCUG | 4 | CAGGUAGUGGUUGUCGGGC | 63 | GfcCfcCfgAfcAfaCfcAfcUfaCfcUfgdTsdT | 64 | pcAfgGfuAfgUfgGfuUfgUfcGfgGfcdTsdT |
| 3 | GCCCGACAACCACUACCUG | 4 | CAGGUAGUGGUUGUCGGGC | 93 | dGcdCcdGadCadAcdCadCudAcdCudGdTsdT | 94 | pcdAgdGudAgdTgdGudTgdTcdGgdGcdTsdT |
| 3 | GCCCGACAACCACUACCUG | 4 | CAGGUAGUGGUUGUCGGGC | 123 | GfdCCfdCGfdACfdAAfdCCfdACfdTAfdCCfdTGfdTsdT | 124 | pdCAfdGGfdTAfdGUfdGGfdTUfdGUfdCGfdGGfdCdTsdT |
| 5 | CGAGAAGCGCGAUCACAUG | 6 | CAUGUGAUCGCGCUUCUCG | 35 | CGAGAAGCGCGAUCACAUGdTdT | 36 | CAUGUGAUCGCGCUUCUCGdTdT |

TABLE 19-continued

Mapping of core sequences and modified sequence

| Core sequences | | Modified sequences | |
|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |
|---|---|---|---|---|---|---|---|
| 5 | CGAGAAGCGCGAUCACAUG | 6 | CAUGUGAUCGCGCUUCUCG | 65 | CfgAfgAfaGfcGfcGfaUfcAfcAfuGfdTsdT | 66 | pcAfuGfuGfaUfcGfcGfcUfuCfuCfgdTsdT |
| 5 | CGAGAAGCGCGAUCACAUG | 6 | CAUGUGAUCGCGCUUCUCG | 95 | dCgdAgdAadGcdGcdGadTcdAcdAudGdTsdT | 96 | pcdAudGudGadTcdGcdGcdTudCudCgdTsdT |
| 5 | CGAGAAGCGCGAUCACAUG | 6 | CAUGUGAUCGCGCUUCUCG | 125 | CfdGAfdGAfdAGfdCGfdCGfdAUfdCAfdCAfdTGfdTsdT | 126 | pdCAfdTGfdTGfdAUfdCGfdCGfdCUfdTCfdTCfdGdTsdT |
| 7 | AUAUCAUGGCCGACAAGCA | 8 | UGCUUGUCGGCCAUGAUAU | 37 | AUAUCAUGGCCGACAAGCAdTdT | 38 | UGCUUGUCGGCCAUGAUAUdTdT |
| 7 | AUAUCAUGGCCGACAAGCA | 8 | UGCUUGUCGGCCAUGAUAU | 67 | AfuAfuCfaUfgGfcCfgAfcAfaGfcAfdTsdT | 68 | puGfcUfuGfuCfgGfcCfaUfgAfuAfudTsdT |
| 7 | AUAUCAUGGCCGACAAGCA | 8 | UGCUUGUCGGCCAUGAUAU | 97 | dAudAudCadTgdGcdCgdAcdAadGcdAdTsdT | 98 | pudGcdTudGudCgdGcdCadTgdAudAudTsdT |
| 7 | AUAUCAUGGCCGACAAGCA | 8 | UGCUUGUCGGCCAUGAUAU | 127 | AfdTAfdTCfdAUfdGGfdCCfdGAfdCAfdAGfdCAfdTsdT | 128 | pdTGfdCUfdTGfdTCfdGGfdCCfdAUfdGAfdTAfdTdTsdT |
| 9 | ACAAGCUGGAGUACAACUA | 10 | UAGUUGUACUCCAGCUUGU | 39 | ACAAGCUGGAGUACAACUAdTdT | 40 | UAGUUGUACUCCAGCUUGUdTdT |
| 9 | ACAAGCUGGAGUACAACUA | 10 | UAGUUGUACUCCAGCUUGU | 69 | AfcAfaGfcUfgGfaGfuAfcAfaCfuAfdTsdT | 70 | puAfgUfuGfuAfcUfcCfaGfcUfuGfudTsdT |
| 9 | ACAAGCUGGAGUACAACUA | 10 | UAGUUGUACUCCAGCUUGU | 99 | dAcdAadGcdTgdGadGudAcdAadCudAdTsdT | 100 | pudAgdTudGudAcdTcdCadGcdTudGudTsdT |
| 9 | ACAAGCUGGAGUACAACUA | 10 | UAGUUGUACUCCAGCUUGU | 129 | AfdCAfdAGfdCUfdGGfdAGfdTAfdCAfdACfdTAfdTsdT | 130 | pdTAfdGUfdTGfdTAfdCUfdCCfdAGfdCUfdTGfdTdTsdT |
| 11 | GCAGCUCGCCGACCACUAC | 12 | GUAGUGGUCGGCGAGCUGC | 41 | GCAGCUCGCCGACCACUACdTdT | 42 | GUAGUGGUCGGCGAGCUGCdTdT |
| 11 | GCAGCUCGCCGACCACUAC | 12 | GUAGUGGUCGGCGAGCUGC | 71 | GfcAfgCfuCfgCfcGfaCfcAfcUfaCfdTsdT | 72 | pgUfaGfuGfgUfcGfgCfgAfgCfuGfcdTsdT |
| 11 | GCAGCUCGCCGACCACUAC | 12 | GUAGUGGUCGGCGAGCUGC | 101 | dGcdAgdCudCgdCcdGadCcdAcdTadCdTsdT | 102 | pgdTadGudGgdTcdGgdCgdAgdCudGcdTsdT |
| 11 | GCAGCUCGCCGACCACUAC | 12 | GUAGUGGUCGGCGAGCUGC | 131 | GfdCAfdGCfdTCfdGCfdCGfdACfdCAfdCUfdACfdTsdT | 132 | pdGUfdAGfdTGfdGUfdCGfdGCfdGAfdGCfdTGfdCdTsdT |
| 13 | CGUCCAGGAGCGCACCAUC | 14 | GAUGGUGCGCUCCUGGACG | 43 | CGUCCAGGAGCGCACCAUCdTdT | 44 | GAUGGUGCGCUCCUGGACGdTdT |
| 13 | CGUCCAGGAGCGCACCAUC | 14 | GAUGGUGCGCUCCUGGACG | 73 | CfgUfcCfaGfgAfgCfgCfaCfcAfuCfdTsdT | 74 | pgAfuGfgUfgCfgCfuCfcUfgGfaCfgdTsdT |

TABLE 19-continued

Mapping of core sequences and modified sequence

| | Core sequences | | | Modified sequences | |
|---|---|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| SEQ ID NO | Sense strand (5'-3') | SEQ ID NO | Antisense strand (5'-3') | SEQ ID NO | Sense strand (5'-3') | SEQ ID NO | Antisense strand (5'-3') |
|---|---|---|---|---|---|---|---|
| 13 | CGUCCAGGAGCGCACCAUC | 14 | GAUGGUGCGCUCCUGGACG | 103 | dCgdTcdCadGgdAgdCgdCadCcdAudCdTsdT | 104 | pgdAudGgdTgdCgdCudCcdTgdGadCgdTsdT |
| 13 | CGUCCAGGAGCGCACCAUC | 14 | GAUGGUGCGCUCCUGGACG | 133 | CfdGUfdCCfdAGfdGAfdGCfdGCfdACfdCAfdTCfdTsdT | 134 | pdGAfdTGfdGUfdGCfdGCfdTCfdCUfdGGfdACfdGdTsdT |
| 15 | GCUGGAGUUCGUGACCGCC | 16 | GGCGGUCACGAACUCCAGC | 45 | GCUGGAGUUCGUGACCGCCdTdT | 46 | GGCGGUCACGAACUCCAGCdTdT |
| 15 | GCUGGAGUUCGUGACCGCC | 16 | GGCGGUCACGAACUCCAGC | 75 | GfcUfgGfaGfuUfcGfuGfaCfcGfcCfdTsdT | 76 | pgGfcGfgUfcAfcGfaAfcUfcCfaGfcdTsdT |
| 15 | GCUGGAGUUCGUGACCGCC | 16 | GGCGGUCACGAACUCCAGC | 105 | dGcdTgdGadGudTcdGudGadCcdGcdCdTsdT | 106 | pgdGcdGgdTcdAcdGadAcdTcdCadGcdTsdT |
| 15 | GCUGGAGUUCGUGACCGCC | 16 | GGCGGUCACGAACUCCAGC | 135 | GfdCUfdGGfdAGfdTUfdCGfdTGfdACfdCGfdCCfdTsdT | 136 | pdGGfdCGfdGUfdCAfdCGfdAAfdCUfdCCfdAGfdCdTsdT |
| 15 | GCUGGAGUUCGUGACCGCC | 16 | GGCGGUCACGAACUCCAGC | 200 | gscUfgGfaGfuUfcGfuGfaCfcGfcCf(invdT) | 213 | pdGsGfcGfgUfcAfcGfaAfcUfcCfaGfcdTsdT |
| 15 | GCUGGAGUUCGUGACCGCC | 16 | GGCGGUCACGAACUCCAGC | 201 | gcUfgGfaGfuUfcGfuGfaCfcGfcCf(invdT) | 214 | dGsGfcGfgUfcAfcGfaAfcUfcCfaGfcdTsdT |
| 15 | GCUGGAGUUCGUGACCGCC | 16 | GGCGGUCACGAACUCCAGC | 202 | gscUfgGfaGfuUfcGfuGfaCfcGfcCfdTsdT | 213 | pdGsGfcGfgUfcAfcGfaAfcUfcCfaGfcTsdT |
| 15 | GCUGGAGUUCGUGACCGCC | 16 | GGCGGUCACGAACUCCAGC | 203 | gcUfgGfaGfuUfcGfuGfaCfcGfcCfdTsdT | 214 | dGsGfcGfgUfcAfcGfaAfcUfcCfaGfcdTsdT |
| 15 | GCUGGAGUUCGUGACCGCC | 16 | GGCGGUCACGAACUCCAGC | 204 | GfcUfgGfaGfuUfcGfuGfaCfcGfcCf(invdT) | 215 | pGfsGfcGfgUfcAfcGfaAfcUfcCfaGfcdTsdT |
| 15 | GCUGGAGUUCGUGACCGCC | 16 | GGCGGUCACGAACUCCAGC | 205 | GfscUfgGfaGfuUfcGfuGfaCfcGfcCf(invdT) | 216 | GfsGfcGfgUfcAfcGfaAfcUfcCfaGfcdTsdT |
| 15 | GCUGGAGUUCGUGACCGCC | 16 | GGCGGUCACGAACUCCAGC | 206 | GfcUfgGfaGfuUfcGfuGfaCfcGfcCfdTsdT | 215 | pGfsGfcGfgUfcAfcGfaAfcUfcCfaGfcdTsdT |
| 15 | GCUGGAGUUCGUGACCGCC | 16 | GGCGGUCACGAACUCCAGC | 200 | gscUfgGfaGfuUfcGfuGfaCfcGfcCf(invdT) | 217 | pdGsGfcGfgUfcAfcGfaAfcUfcCfaGfc(invdT) |
| 15 | GCUGGAGUUCGUGACCGCC | 16 | GGCGGUCACGAACUCCAGC | 207 | GfcUfgGfaGfuUfcGfuGfaCfcGfcCfdT(invdT) | 218 | pGfsGfcGfgUfcAfcGfaAfcUfcCfaGfcdT(invdT) |
| 15 | GCUGGAGUUCGUGACCGCC | 16 | GGCGGUCACGAACUCCAGC | 208 | gscUfgGfaGfuUfcGfuGfaCfcGfcCfdT(invdT) | 219 | pdGsGfcGfgUfcAfcGfaAfcUfcCfaGfcd(invdT) |
| 15 | GCUGGAGUUCGUGACCGCC | 16 | GGCGGUCACGAACUCCAGC | 205 | GfscUfgGfaGfuUfcGfuGfaCfcGfcCf(invdT) | 220 | GfsGfcGfgUfcAfcGfaAfcUfcCfaGfc(invdT) |

TABLE 19-continued

Mapping of core sequences and modified sequence

| Core sequences | | Modified sequences | |
|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| Core SEQ ID NO Sense (5'-3') | Core SEQ ID NO Antisense (5'-3') | Mod SEQ ID NO Sense (5'-3') | Mod SEQ ID NO Antisense (5'-3') |
|---|---|---|---|
| 15 GCUGGAGUUCGUGACCGCC | 16 GGCGGUCACGAACUCCAGC | 201 gcUfgGfaGfuUfcGfuGfaCfcGfcCf(invdT) | 221 dGsGfcGfgUfcAfcGfaAfcUfcCfaGfc(invdT) |
| 15 GCUGGAGUUCGUGACCGCC | 16 GGCGGUCACGAACUCCAGC | 209 GfscUfgGfaGfuUfcGfuGfaCfcGfcCfdTsdT | 216 GfsGfcGfgUfcAfcGfaAfcUfcCfaGfcdTsdT |
| 15 GCUGGAGUUCGUGACCGCC | 16 GGCGGUCACGAACUCCAGC | 210 GfscUfgGfaGfuUfcGfuGfaCfcGfcCfdT(invdT) | 222 GfsGfcGfgUfcAfcGfaAfcUfcCfaGfcdT(invdT) |
| 15 GCUGGAGUUCGUGACCGCC | 16 GGCGGUCACGAACUCCAGC | 211 gcUfgGfaGfuUfcGfuGfaCfcGfcCfdT(invdT) | 223 dGsGfcGfgUfcAfcGfaAfcUfcCfaGfcdT(invdT) |
| 15 GCUGGAGUUCGUGACCGCC | 16 GGCGGUCACGAACUCCAGC | 204 GfcUfgGfaGfuUfcGfuGfaCfcGfcCf(invdT) | 224 pGfsGfcGfgUfcAfcGfaAfcUfcCfaGfc(invdT) |
| 15 GCUGGAGUUCGUGACCGCC | 16 GGCGGUCACGAACUCCAGC | 45 GCUGGAGUUCGUGACCGCCdTdT | 46 GGCGGUCACGAACUCCAGCdTdT |
| 15 GCUGGAGUUCGUGACCGCC | 16 GGCGGUCACGAACUCCAGC | 212 GcuGGAGuucGuGAccGccdTsdT | 225 GGCGGUcACGAACUCcAGCdTsdT |
| 17 CCACCCUGACCUACGGCGU | 18 ACGCCGUAGGUCAGGGUGG | 47 CCACCCUGACCUACGGCGUdTdT | 48 ACGCCGUAGGUCAGGGUGGdTdT |
| 17 CCACCCUGACCUACGGCGU | 18 ACGCCGUAGGUCAGGGUGG | 77 CfcAfcCfcUfgAfcCfuAfcGfgCfgUfdTsdT | 78 paCfgCfcGfuAfgGfuCfaGfgGfuGfgdTsdT |
| 17 CCACCCUGACCUACGGCGU | 18 ACGCCGUAGGUCAGGGUGG | 107 dCcdAcdCcdTgdAcdCudAcdGgdCgdTdTsdT | 108 padCgdCcdGudAgdGudCadGgdGudGgdTsdT |
| 17 CCACCCUGACCUACGGCGU | 18 ACGCCGUAGGUCAGGGUGG | 137 CfdCAfdCCfdCUfdGAfdCCfdTAfdCGfdGCfdGUfdTsdT | 138 pdACfdGCfdCGfdTAfdGGfdTCfdAGfdGGfdTGfdGdTsdT |
| 19 CGACUUCAAGGAGGACGGC | 20 GCCGUCCUCCUUGAAGUCG | 49 CGACUUCAAGGAGGACGGCdTdT | 50 GCCGUCCUCCUUGAAGUCGdTdT |
| 19 CGACUUCAAGGAGGACGGC | 20 GCCGUCCUCCUUGAAGUCG | 79 CfgAfcUfuCfaAfgGfaGfgAfcGfgCfdTsdT | 80 pgCfcGfuCfcUfcCfuUfgAfaGfuCfgdTsdT |
| 19 CGACUUCAAGGAGGACGGC | 20 GCCGUCCUCCUUGAAGUCG | 109 dCgdAcdTudCadAgdGadGgdAcdGgdCdTsdT | 110 pgdCcdGudCcdTcdCudTgdAadGudCgdTsdT |
| 19 CGACUUCAAGGAGGACGGC | 20 GCCGUCCUCCUUGAAGUCG | 139 CfdGAfdCUfdTCfdAAfdGGfdAGfdGAfdCGfdGCfdTsdT | 140 pdGCfdCGfdTCfdCUfdCCfdTUfdGAfdAGfdTCfdGdTsdT |
| 21 UUCAAGAUCCGCCACAACA | 22 UGUUGUGGCGGAUCUUGAA | 51 UUCAAGAUCCGCCACAACAdTdT | 52 UGUUGUGGCGGAUCUUGAAdTdT |
| 21 UUCAAGAUCCGCCACAACA | 22 UGUUGUGGCGGAUCUUGAA | 81 UfuCfaAfgAfuCfcGfcCfaCfaAfcAfdTsdT | 82 puGfuUfgUfgGfcGfgAfuCfuUfgAfadTsdT |

TABLE 19-continued

Mapping of core sequences and modified sequence

| | Core sequences | | | Modified sequences | |
|---|---|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |
|---|---|---|---|---|---|---|---|
| 21 | UUCAAGAUCCGCCACAACA | 22 | UGUUGUGGCGGAUCUUGAA | 111 | dTudCadAgdAudCcdGcdCadCadAcdAdTsdT | 112 | pudGudTgdTgdGcdGgdAudCudTgdAadTsdT |
| 21 | UUCAAGAUCCGCCACAACA | 22 | UGUUGUGGCGGAUCUUGAA | 141 | UfdTCfdAAfdGAfdTCfdCGfdCCfdACfdAAfdCAfdTsdT | 142 | pdTGfdTUfdGUfdGGfdCGfdGAfdTCfdTUfdGAfdAdTsdT |
| 23 | GGCAACUACAAGACCCGCG | 24 | CGCGGGUCUUGUAGUUGCC | 53 | GGCAACUACAAGACCCGCGdTdT | 54 | CGCGGGUCUUGUAGUUGCCdTdT |
| 23 | GGCAACUACAAGACCCGCG | 24 | CGCGGGUCUUGUAGUUGCC | 83 | GfgCfaAfcUfaCfaAfgAfcCfcGfcGfdTsdT | 84 | pcGfcGfgGfuCfuUfgUfaGfuUfgCfcdTsdT |
| 23 | GGCAACUACAAGACCCGCG | 24 | CGCGGGUCUUGUAGUUGCC | 113 | dGgdCadAcdTadCadAgdAcdCcdGcdGdTsdT | 114 | pcdGcdGgdGudCudTgdTadGudTgdCcdTsdT |
| 23 | GGCAACUACAAGACCCGCG | 24 | CGCGGGUCUUGUAGUUGCC | 143 | GfdGCfdAAfdCUfdACfdAAfdGAfdCCfdCGfdCGfdTsdT | 144 | pdCGfdCGfdGGfdTCfdTUfdGUfdAGfdTUfdGCfdCdTsdT |
| 25 | CCGGCAAGCUGCCCGUGCC | 26 | GGCACGGGCAGCUUGCCGG | 55 | CCGGCAAGCUGCCCGUGCCdTdT | 56 | GGCACGGGCAGCUUGCCGGdTdT |
| 25 | CCGGCAAGCUGCCCGUGCC | 26 | GGCACGGGCAGCUUGCCGG | 85 | CfcGfgCfaAfgCfuGfcCfcGfuGfcCfdTsdT | 86 | pgGfcAfcGfgGfcAfgCfuUfgCfcGfgdTsdT |
| 25 | CCGGCAAGCUGCCCGUGCC | 26 | GGCACGGGCAGCUUGCCGG | 115 | dCcdGgdCadAgdCudGcdCcdGudGcdCdTsdT | 116 | pgdGcdAcdGgdGcdAgdCudTgdCcdGgdTsdT |
| 25 | CCGGCAAGCUGCCCGUGCC | 26 | GGCACGGGCAGCUUGCCGG | 145 | CfdCGfdGCfdAAfdGCfdTGfdCCfdCGfdTGfdCCfdTsdT | 146 | pdGGfdCAfdCGfdGGfdCAfdGCfdTUfdGCfdCGfdGdTsdT |
| 27 | UGCCCAUCCUGGUCGAGCU | 28 | AGCUCGACCAGGAUGGGCA | 57 | UGCCCAUCCUGGUCGAGCUdTdT | 58 | AGCUCGACCAGGAUGGGCAdTdT |
| 27 | UGCCCAUCCUGGUCGAGCU | 28 | AGCUCGACCAGGAUGGGCA | 87 | UfgCfcCfaUfcCfuGfgUfcGfaGfcUfdTsdT | 88 | paGfcUfcGfaCfcAfgGfaUfgGfgCfadTsdT |
| 27 | UGCCCAUCCUGGUCGAGCU | 28 | AGCUCGACCAGGAUGGGCA | 117 | dTgdCcdCadTcdCudGgdTcdGadGcdTdTsdT | 118 | padGcdTcdGadCcdAgdGadTgdGgdCadTsdT |
| 27 | UGCCCAUCCUGGUCGAGCU | 28 | AGCUCGACCAGGAUGGGCA | 147 | UfdGCfdCCfdAUfdCCfdTGfdGUfdCGfdAGfdCUfdTsdT | 148 | pdAGfdCUfdCGfdACfdCAfdGGfdAUfdGGfdGCfdAdTsdT |
| 29 | CAAGUUCAGCGUGUCCGGC | 30 | GCCGGACACGCUGAACUUG | 59 | CAAGUUCAGCGUGUCCGGCdTdT | 60 | GCCGGACACGCUGAACUUGdTdT |
| 29 | CAAGUUCAGCGUGUCCGGC | 30 | GCCGGACACGCUGAACUUG | 89 | CfaAfgUfuCfaGfcGfuGfuCfcGfgCfdTsdT | 90 | pgCfcGfgAfcAfcGfcUfgAfaCfuUfgdTsdT |
| 29 | CAAGUUCAGCGUGUCCGGC | 30 | GCCGGACACGCUGAACUUG | 119 | dCadAgdTudCadGcdGudGudCcdGgdCdTsdT | 120 | pgdCcdGgdAcdAcdGcdTgdAadCudTgdTsdT |

TABLE 19-continued

Mapping of core sequences and modified sequence

| Core sequences | | Modified sequences | |
|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| Core SEQ ID NO Sense (5'-3') | Core SEQ ID NO Antisense (5'-3') | Modified SEQ ID NO Sense (5'-3') | Modified SEQ ID NO Antisense (5'-3') |
|---|---|---|---|
| 29 CAAGUUCAGCGUGUCCGGC | 30 GCCGGACACGCUGAACUUG | 149 CfdAAfdGUfdTCfdAGfdCGfdTGfdTCfdCGfdGCfdTsdT | 150 pdGCfdCGfdGAfdCAfdCGfdCUfdGAfdACfdTUfdGdTsdT |
| 151 GGAAUCUUAUAUUUGAUCCAA | 152 UUGGAUCAAAUAUAAGAUUCCCU | 153 GGAAUCuuAuAuuuGAUCcAsA | 154 uuGGAUcAAAuAuAAGAuUCcscsU |
| 151 GGAAUCUUAUAUUUGAUCCAA | 152 UUGGAUCAAAUAUAAGAUUCCCU | 265 Chol-pGGAAUCuuAuAuuuGAUCcAsA | 154 uuGGAUcAAAuAuAAGAuUCcscsU |
| 155 GGAUGAAGUGGAGAUUAGU | 156 ACUAAUCUCCACUUCAUCC | 157 GGAuGAAGuGGAGAuuAGudTsdT | 158 ACuAAUCUCcACUUcAUCCdTsdT |
| 155 GGAUGAAGUGGAGAUUAGU | 156 ACUAAUCUCCACUUCAUCC | 160 (NH2C6)GfgAfuGfaAfgUfgGfaG faUfuAfgUf(invdT) | 159 pasCfuAfaUfcUfcCfaCfuUfcAfuCfc(invdT) |
| 155 GGAUGAAGUGGAGAUUAGU | 156 ACUAAUCUCCACUUCAUCC | 226 gsgAfuGfaAfgUfgGfaGfaUfuAfgUfdTsdT | 266 pdAsCfuAfaUfcUfcCfaCfuUfcAfuCfcdTsdT |
| 155 GGAUGAAGUGGAGAUUAGU | 156 ACUAAUCUCCACUUCAUCC | 227 gsgAfuGfaAfgUfgGfaGfaUfuAfgUf(invdT) | 266 pdAsCfuAfaUfcUfcCfaCfuUfcAfuCfcdTsdT |
| 155 GGAUGAAGUGGAGAUUAGU | 156 ACUAAUCUCCACUUCAUCC | 228 GfsgAfuGfaAfgUfgGfaGfaUfuAfgUfdTsdT | 267 pAfsCfuAfaUfcUfcCfaCfuUfcAfuCfcdTsdT |
| 155 GGAUGAAGUGGAGAUUAGU | 156 ACUAAUCUCCACUUCAUCC | 229 GfsgAfuGfaAfgUfgGfaGfaUfuAfgUfdT(invdT) | 268 pAfsCfuAfaUfcUfcCfaCfuUfcAfuCfcdT(invdT) |
| 155 GGAUGAAGUGGAGAUUAGU | 156 ACUAAUCUCCACUUCAUCC | 230 ggAfuGfaAfgUfgGfaGfaUfuAfgUfdTsdT | 238 dAsCfuAfaUfcUfcCfaCfuUfcAfuCfcdTsdT |
| 155 GGAUGAAGUGGAGAUUAGU | 156 ACUAAUCUCCACUUCAUCC | 231 GfsgAfuGfaAfgUfgGfaGfaUfuAfgUf(invdT) | 267 pAfsCfuAfaUfcUfcCfaCfuUfcAfuCfcdTsdT |
| 155 GGAUGAAGUGGAGAUUAGU | 156 ACUAAUCUCCACUUCAUCC | 232 ggAfuGfaAfgUfgGfaGfaUfuAfgUf(invdT) | 238 dAsCfuAfaUfcUfcCfaCfuUfcAfuCfcdTsdT |
| 155 GGAUGAAGUGGAGAUUAGU | 156 ACUAAUCUCCACUUCAUCC | 233 GfgAfuGfaAfgUfgGfaGfaUfuAfgUfdT(invdT) | 239 AfsCfuAfaUfcUfcCfaCfuUfcAfuCfcdT(invdT) |
| 155 GGAUGAAGUGGAGAUUAGU | 156 ACUAAUCUCCACUUCAUCC | 234 GfgAfuGfaAfgUfgGfaGfaUfuAfgUf(invdT) | 240 AfsCfuAfaUfcUfcCfaCfuUfcAfuCfcdTsdT |
| 155 GGAUGAAGUGGAGAUUAGU | 156 ACUAAUCUCCACUUCAUCC | 231 GfsgAfuGfaAfgUfgGfaGfaUfuAfgUf(invdT) | 241 pAfsCfuAfaUfcUfcCfaCfuUfcAfuCfc(invdT) |
| 155 GGAUGAAGUGGAGAUUAGU | 156 ACUAAUCUCCACUUCAUCC | 234 GfgAfuGfaAfgUfgGfaGfaUfuAfgUf(invdT) | 159 pasCfuAfaUfcUfcCfaCfuUfcAfuCfc(invdT) |
| 155 GGAUGAAGUGGAGAUUAGU | 156 ACUAAUCUCCACUUCAUCC | 235 gsgAfuGfaAfgUfgGfaGfaUfuAfgUfdT(invdT) | 242 pdAsCfuAfaUfcUfcCfaCfuUfcAfuCfcdT(invdT) |

TABLE 19-continued

Mapping of core sequences and modified sequence

| Core sequences | | Modified sequences | |
| --- | --- | --- | --- |
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| Core SEQ ID NO (Sense) | Sense strand sequence (5'-3') | Core SEQ ID NO (Antisense) | Antisense strand sequence (5'-3') | Mod SEQ ID NO (Sense) | Sense strand sequence (5'-3') | Mod SEQ ID NO (Antisense) | Antisense strand sequence (5'-3') |
| --- | --- | --- | --- | --- | --- | --- | --- |
| 155 | GGAUGAAGUGGAGAUUAGU | 156 | ACUAAUCUCCACUUCAUCC | 236 | GfgAfuGfaAfgUfgGfaGfaUfuAfgUfdTsdT | 240 | AfsCfuAfaUfcUfcCfaCfuUfcAfuCfcdTsdT |
| 155 | GGAUGAAGUGGAGAUUAGU | 156 | ACUAAUCUCCACUUCAUCC | 227 | gsgAfuGfaAfgUfgGfaGfaUfuAfgUf(invdT) | 243 | pdAsCfuAfaUfcUfcCfaCfuUfcAfuCfc(invdT) |
| 155 | GGAUGAAGUGGAGAUUAGU | 156 | ACUAAUCUCCACUUCAUCC | 237 | ggAfuGfaAfgUfgGfaGfaUfuAfgUfdT(invdT) | 244 | dAsCfuAfaUfcUfcCfaCfuUfcAfuCfcdT(invdT) |
| 155 | GGAUGAAGUGGAGAUUAGU | 156 | ACUAAUCUCCACUUCAUCC | 232 | ggAfuGfaAfgUfgGfaGfaUfuAfgUf(invdT) | 245 | dAsCfuAfaUfcUfcCfaCfuUfcAfuCfc(invdT) |
| 155 | GGAUGAAGUGGAGAUUAGU | 156 | ACUAAUCUCCACUUCAUCC | 234 | GfgAfuGfaAfgUfgGfaGfaUfuAfgUf(invdT) | 246 | AfsCfuAfaUfcUfcCfaCfuUfcAfuCfc(invdT) |
| 155 | GGAUGAAGUGGAGAUUAGU | 156 | ACUAAUCUCCACUUCAUCC | 157 | GGAuGAAGuGGAGAuuAGudTsdT | 158 | ACuAAUCUCcACUUcAUCCdTsdT |
| 161 | GCAAAGGCGUGCCAACUCA | 162 | UGAGUUGGCACGCCUUUGC | 165 | (NH2C6)GfcAfaAfgGfcGfuGfcCfaAfcUfcAf(invdT) | 166 | puGfaGfuUfgGfcAfcGfcCfuUfuGfc(invdT) |
| 161 | GCAAAGGCGUGCCAACUCA | 162 | UGAGUUGGCACGCCUUUGC | 167 | (NH2C6)GcAAAGGcGuGccAAcucAdTsdT | 168 | UGAGUUGGcACGCCUUUGCdTsdT |
| 161 | GCAAAGGCGUGCCAACUCA | 162 | UGAGUUGGCACGCCUUUGC | 179 | GalNAc-(NHC6)-GfcAfaAfgGfcGfuGfcCfaAfcUfcAf(invdT) | 166 | puGfaGfuUfgGfcAfcGfcCfuUfuGfc(invdT) |
| 161 | GCAAAGGCGUGCCAACUCA | 162 | UGAGUUGGCACGCCUUUGC | 180 | GalNAc-(NHC6)-GcAAAGGcGuGccAAcucAdTsdT | 168 | UGAGUUGGcACGCCUUUGCdTsdT |
| 161 | GCAAAGGCGUGCCAACUCA | 162 | UGAGUUGGCACGCCUUUGC | 181 | GfcAfaAfgGfcGfuGfcCfaAfcUfcAf(invdT) | 185 | pUfsGfaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 186 | psdTdGaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 187 | psdTsGfaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 188 | pdTsdGaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 189 | pdTsGfaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 190 | pusGfaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 166 | puGfaGfuUfgGfcAfcGfcCfuUfuGfc(invdT) |

TABLE 19-continued

Mapping of core sequences and modified sequence

| Core sequences | | Modified sequences | |
|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |
|---|---|---|---|---|---|---|---|
| 161 | GCAAAGGCGUGCCAACUCA | 162 | UGAGUUGGCACGCCUUUGC | 181 | GfcAfaAfgGfcGfuGfcCfaAfcUfcAf(invdT) | 191 | psUfGfaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 192 | UfsGfaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 193 | psUfsGfaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 194 | psdTsdGaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 195 | usGfaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 196 | uGfaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 197 | dTsGfaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 198 | psdTGfaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 199 | dTsdGaGfuUfgGfcAfcGfcCfuUfuGfc(invdT) |
| 161 | GCAAAGGCGUGCCAACUCA | 162 | UGAGUUGGCACGCCUUUGC | 257 | Chol-pGfcAfaAfgGfcGfuGfcCfaAfcUfcAf(invdT) | 190 | pusGfaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 196 | uGfaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 195 | usGfaGfuUfgGfcAfcGfcCfuUfuGfc(invdT) |
| 161 | GCAAAGGCGUGCCAACUCA | 162 | UGAGUUGGCACGCCUUUGC | 181 | GfcAfaAfgGfcGfuGfcCfaAfcUfcAf(invdT) | 192 | UfsGfaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 197 | dTsGfaGfuUfgGfcAfcGfcCfuUfuGfc(invdT) |
| 161 | GCAAAGGCGUGCCAACUCA | 178 | TGAGUUGGCACGCCUUUGC | 181 | GfcAfaAfgGfcGfuGfcCfaAfcUfcAf(invdT) | 199 | dTsdGaGfuUfgGfcAfcGfcCfuUfuGfc(invdT) |
| 161 | GCAAAGGCGUGCCAACUCA | 162 | UGAGUUGGCACGCCUUUGC | 182 | GcAAAGGcGuGccAAcucAdTsdT | 168 | UGAGUUGGcACGCCUUUGCdTsdT |
| 161 | GCAAAGGCGUGCCAACUCA | 162 | UGAGUUGGCACGCCUUUGC | 184 | GfcAfaAfgGfcGfuGfcCfaAfcUfcA | 168 | UGAGUUGGcACGCCUUUGCdTsdT |

TABLE 19-continued

Mapping of core sequences and modified sequence

| Core sequences | | Modified sequences | |
|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |
|---|---|---|---|---|---|---|---|
| 161 | GCAAAGGCGUGCCAACUCA | 162 | UGAGUUGGCACGCCUUUGC | 179 | GalNAc-(NHC6)-GfcAfaAfgGfcGfuGfcCfaAfcUfcAf(invdT) | 166 | puGfaGfuUfgGfcAfcGfcCfuUfuGfc(invdT) |
| 161 | GCAAAGGCGUGCCAACUCA | 162 | UGAGUUGGCACGCCUUUGC | 179 | GalNAc-(NHC6)-GfcAfaAfgGfcGfuGfcCfaAfcUfcAf(invdT) | 190 | pusGfaGfuUfgGfcAfcGfcCfuUfuGfc(invdT) |
| 161 | GCAAAGGCGUGCCAACUCA | 162 | UGAGUUGGCACGCCUUUGC | 179 | GalNAc-(NHC6)-GfcAfaAfgGfcGfuGfcCfaAfcUfcAf(invdT) | 185 | pUfsGfaGfuUfgGfcAfcGfcCfuUfuGfc(invdT) |
| 161 | GCAAAGGCGUGCCAACUCA | 178 | TGAGUUGGCACGCCUUUGC | 179 | GalNAc-(NHC6)-GfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 162 | UGAGUUGGCACGCCUUUGC | 179 | GalNAc-(NHC6)-GfcAfaAfgGfcGfuGfcCfaAfcUfcAf(invdT) | 166 | puGfaGfuUfgGfcAfcGfcCfuUfuGfc(invdT) |
| 161 | GCAAAGGCGUGCCAACUCA | 162 | UGAGUUGGCACGCCUUUGC | 179 | GalNAc-(NHC6)-GfcAfaAfgGfcGfuGfcCfaAfcUfcAf(invdT) | 190 | pusGfaGfuUfgGfcAfcGfcCfuUfuGfc(invdT) |
| 161 | GCAAAGGCGUGCCAACUCA | 162 | UGAGUUGGCACGCCUUUGC | 179 | GalNAc-(NHC6)-GfcAfaAfgGfcGfuGfcCfaAfcUfcAf(invdT) | 262 | pUfsGfaGfuUfgGfcAfcGfcCfuUfuGfc(invdT) |
| 161 | GCAAAGGCGUGCCAACUCA | 178 | TGAGUUGGCACGCCUUUGC | 179 | GalNAc-(NHC6)-GfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 162 | UGAGUUGGCACGCCUUUGC | 257 | Chol-pGfcAfaAfgGfcGfuGfcCfaAfcUfcAf(invdT) | 166 | puGfaGfuUfgGfcAfcGfcCfuUfuGfc(invdT) |
| 161 | GCAAAGGCGUGCCAACUCA | 162 | UGAGUUGGCACGCCUUUGC | 257 | Chol-pGfcAfaAfgGfcGfuGfcCfaAfcUfcAf(invdT) | 190 | pusGfaGfuUfgGfcAfcGfcCfuUfuGfc(invdT) |
| 161 | GCAAAGGCGUGCCAACUCA | 162 | UGAGUUGGCACGCCUUUGC | 257 | Chol-pGfcAfaAfgGfcGfuGfcCfaAfcUfcAf(invdT) | 264 | pUfsGfaGfuUfgGfcAfcGfcCfuUfuGfc(invdT) |
| 161 | GCAAAGGCGUGCCAACUCA | 178 | TGAGUUGGCACGCCUUUGC | 257 | Chol-pGfcAfaAfgGfcGfuGfcCfaAfcUfcAf(invdT) | 263 | psdTdGfaGfuUfgGfcAfcGfcCfuUfuGfc(invdT) |

TABLE 19-continued

Mapping of core sequences and modified sequence

| Core sequences | | Modified sequences | |
|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |
|---|---|---|---|---|---|---|---|
| 161 | GCAAAGGCGUGCCAACUCA | 162 | UGAGUUGGCACGCCUUUGC | 258 | Chol-pGcAAAGGcGuGccAAcucAdTsdT | 168 | UGAGUUGGcACGCCUUUGCdTsdT |
| 161 | GCAAAGGCGUGCCAACUCA | 178 | TGAGUUGGCACGCCUUUGC | 257 | Chol-pGfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 178 | TGAGUUGGCACGCCUUUGC | 259 | Chol-C6SSC6-GfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 178 | TGAGUUGGCACGCCUUUGC | 260 | Chol-AUC-GfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 178 | TGAGUUGGCACGCCUUUGC | 261 | Chol-Cathepsin-(NHC6)-pGfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 178 | TGAGUUGGCACGCCUUUGC | 257 | Chol-pGfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 178 | TGAGUUGGCACGCCUUUGC | 259 | Chol-C6SSC6-GfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 178 | TGAGUUGGCACGCCUUUGC | 260 | Chol-AUC-GfcAfaAfgGfcGfuGfcCfaAfcUfcAf(invdT) | 263 | psdTdGfaGfuUfgGfcAfcGfcCfuUfuGfc(invdT) |
| 161 | GCAAAGGCGUGCCAACUCA | 178 | TGAGUUGGCACGCCUUUGC | 261 | Chol-Cathepsin-(NHC6)-pGfcAfaAfgGfcGfuGfcCfaAfcUfcAf(invdT) | 263 | psdTdGfaGfuUfgGfcAfcGfcCfuUfuGfc(invdT) |
| 163 | GGAUCAUCUCAAGUCUUAC | 164 | GUAAGACUUGAGAUGAUCC | 169 | (NH2C6)GGAUfCfAUfCfUfCfAAGUfCfUfUfACfdTsdT | 170 | GUfAAGACfUfUfGAGAUfGAUfCfCfdTsdT |
| 171 | UGACCACAGUCGGAUUAAA | 172 | UUUAAUCCGACUGUGGUCA | 173 | (NH2C6)UfgAfcCfaCfaGfuCfgGfaUfuAfaAf(invdT) | 174 | pusUfuAfaUfcCfgAfcUfgUfgGfuCfa(invdT) |
| 171 | UGACCACAGUCGGAUUAAA | 172 | UUUAAUCCGACUGUGGUCA | 175 | (NH2C6)uGAccAcAGucGGAuuAAAdTsdT | 176 | puUuAAUCCGACUGUGGucAdTsdT |
| 171 | UGACCACAGUCGGAUUAAA | 172 | UUUAAUCCGACUGUGGUCA | 175 | (NH2C6)uGAccAcAGucGGAuuAAAdTsdT | 177 | UUuAAUCCGACUGUGGUcAdTsdT |

TABLE 19-continued

Mapping of core sequences and modified sequence

| Core sequences | | Modified sequences | |
|---|---|---|---|
| SEQ ID NO | Sense strand sequence (5'-3') | SEQ ID NO | Antisense strand sequence (5'-3') | SEQ ID NO | Sense strand sequence (5'-3') | SEQ ID NO | Antisense strand sequence (5'-3') |

| Core Sense SEQ ID | Core Sense sequence | Core Antisense SEQ ID | Core Antisense sequence | Mod Sense SEQ ID | Mod Sense sequence | Mod Antisense SEQ ID | Mod Antisense sequence |
|---|---|---|---|---|---|---|---|
| 247 | GUUGGUGAAUGGAGCUCAG | 248 | CUGAGCUCCAUUCACCAAC | 251 | (NH2C6)GfuUfgGfuGfaAfuGfgAfgCfuCfaGf(invdT) | 252 | pCfsUfgAfgCfuCfcAfuUfcAfcCfaAfc(invdT) |
| 247 | GUUGGUGAAUGGAGCUCAG | 248 | CUGAGCUCCAUUCACCAAC | 251 | (NH2C6)GfuUfgGfuGfaAfuGfgAfgCfuCfaGf(invdT) | 255 | pCfsUfgAfgCfuCfcAfuUfcAfcCfaAfcdTsdT |
| 249 | GGUCCUGUUGUUGGUGAAU | 250 | AUUCACCAACACAGGACC | 253 | (NH2C6)GfgUfcCfuGfuUfgUfuGfgUfgAfaUf(invdT) | 254 | pAfsUfuCfaCfcAfaCfaAfcAfgGfaCfcdTsdT |
| 256 | UAUGCAAAGGCGUGCCAACUCA | 178 | TGAGUUGGCACGCCUUUGC | 276 | Chol-uAu-GfcAfaAfgGfcGfuGfcCfaAfcUfcAf(invdT) | 282 | pdTsGfaGfuUfgGfcAfcGfcCfuUfuGfcdTsdT |
| 271 | UGUGCAAAGGCGUGCCAACUCA | 178 | TGAGUUGGCACGCCUUUGC | 277 | Chol-uGu-GfcAfaAfgGfcGfuGfcCfaAfcUfcAf(invdT) | 282 | pdTsGfaGfuUfgGfcAfcGfcCfuUfuGfcdTsdT |
| 272 | UAUUGCAAAGGCGUGCCAACUCA | 178 | TGAGUUGGCACGCCUUUGC | 278 | Chol-uAuu-GfcAfaAfgGfcGfuGfcCfaAfcUfcAf(invdT) | 282 | pdTsGfaGfuUfgGfcAfcGfcCfuUfuGfcdTsdT |
| 273 | UGUUGCAAAGGCGUGCCAACUCA | 178 | TGAGUUGGCACGCCUUUGC | 279 | Chol-uGuu-GfcAfaAfgGfcGfuGfcCfaAfcUfcAf(invdT) | 282 | pdTsGfaGfuUfgGfcAfcGfcCfuUfuGfcdTsdT |
| 274 | UUAGGCAAAGGCGUGCCAACUCA | 178 | TGAGUUGGCACGCCUUUGC | 280 | Chol-uuAG-GfcAfaAfgGfcGfuGfcCfaAfcUfcAf(invdT) | 282 | pdTsGfaGfuUfgGfcAfcGfcCfuUfuGfcdTsdT |
| 275 | UAGUGCAAAGGCGUGCCAACUCA | 178 | TGAGUUGGCACGCCUUUGC | 281 | Chol-uAGu-GfcAfaAfgGfcGfuGfcCfaAfcUfcAf(invdT) | 282 | pdTsGfaGfuUfgGfcAfcGfcCfuUfuGfcdTsdT |

SEQUENCE LISTING (293 sequences)

SEQ ID NO: 1 - RNA, 19 nt, Artificial Sequence
  Description of Artificial Sequence: Synthetic sense strand of dsRNA oligonucleotide
acaugaagcagcacgacuu

SEQ ID NO: 2 - RNA, 19 nt, Artificial Sequence
  Description of Artificial Sequence: Synthetic antisense strand of dsRNA oligonucleotide
aagucgugcugcuucaugu

SEQ ID NO: 3 - RNA, 19 nt, Artificial Sequence
  Description of Artificial Sequence: Synthetic sense strand of dsRNA oligonucleotide
gcccgacaaccacuaccug

SEQ ID NO: 4 - RNA, 19 nt, Artificial Sequence
  Description of Artificial Sequence: Synthetic antisense strand of dsRNA oligonucleotide
cagguagugguugucgggc

SEQ ID NO: 5 - RNA, 19 nt, Artificial Sequence
  Description of Artificial Sequence: Synthetic sense strand of dsRNA oligonucleotide
cgagaagcgcgaucacaug

SEQ ID NO: 6 - RNA, 19 nt, Artificial Sequence
  Description of Artificial Sequence: Synthetic antisense strand of dsRNA oligonucleotide
caugugaucgcgcuucucg

SEQ ID NO: 7 - RNA, 19 nt, Artificial Sequence
  Description of Artificial Sequence: Synthetic sense strand of dsRNA oligonucleotide
auaucauggccgacaagca

SEQ ID NO: 8 - RNA, 19 nt, Artificial Sequence
  Description of Artificial Sequence: Synthetic antisense strand of dsRNA oligonucleotide
ugcuugucggccaugauau

SEQ ID NO: 9 - RNA, 19 nt, Artificial Sequence
  Description of Artificial Sequence: Synthetic sense strand of dsRNA oligonucleotide
acaagcuggaguacaacua

SEQ ID NO: 10 - RNA, 19 nt, Artificial Sequence
  Description of Artificial Sequence: Synthetic antisense strand of dsRNA oligonucleotide
uaguuguacuccagcuugu

SEQ ID NO: 11 - RNA, 19 nt, Artificial Sequence
  Description of Artificial Sequence: Synthetic sense strand of dsRNA oligonucleotide
gcagcucgccgaccacuac

SEQ ID NO: 12 - RNA, 19 nt, Artificial Sequence
  Description of Artificial Sequence: Synthetic antisense strand of dsRNA oligonucleotide
guaguggucggcgagcugc

SEQ ID NO: 13 - RNA, 19 nt, Artificial Sequence
  Description of Artificial Sequence: Synthetic sense strand of dsRNA oligonucleotide
cguccaggagcgcaccauc

SEQ ID NO: 14 - RNA, 19 nt, Artificial Sequence
  Description of Artificial Sequence: Synthetic antisense strand of dsRNA oligonucleotide
gauggugcgcuccuggacg

SEQ ID NO: 15 - RNA, 19 nt, Artificial Sequence
  Description of Artificial Sequence: Synthetic sense strand of dsRNA oligonucleotide
gcuggaguucgugaccgcc

SEQ ID NO: 16 - RNA, 19 nt, Artificial Sequence
  Description of Artificial Sequence: Synthetic antisense strand of dsRNA oligonucleotide
ggcggucacgaacuccagc

SEQ ID NO: 17 - RNA, 19 nt, Artificial Sequence
  Description of Artificial Sequence: Synthetic sense strand of dsRNA oligonucleotide
ccacccugaccuacggcgu

SEQ ID NO: 18 - RNA, 19 nt, Artificial Sequence
  Description of Artificial Sequence: Synthetic antisense strand of dsRNA oligonucleotide
acgccguaggucagggugg

SEQ ID NO: 19 - RNA, 19 nt, Artificial Sequence
  Description of Artificial Sequence: Synthetic sense strand of dsRNA oligonucleotide
cgacuucaaggaggacggc

SEQ ID NO: 20 - RNA, 19 nt, Artificial Sequence
  Description of Artificial Sequence: Synthetic antisense strand of dsRNA oligonucleotide
gccguccuccuugaagucg

SEQ ID NO: 21 - RNA, 19 nt, Artificial Sequence
  Description of Artificial Sequence: Synthetic sense strand of dsRNA oligonucleotide
uucaagauccgccacaaca

SEQ ID NO: 22 - RNA, 19 nt, Artificial Sequence
  Description of Artificial Sequence: Synthetic antisense strand of dsRNA oligonucleotide
uguuguggcggaucuugaa

SEQ ID NO: 23 - RNA, 19 nt, Artificial Sequence
  Description of Artificial Sequence: Synthetic sense strand of dsRNA oligonucleotide
ggcaacuacaagacccgcg

SEQ ID NO: 24 - RNA, 19 nt, Artificial Sequence
  Description of Artificial Sequence: Synthetic antisense strand of dsRNA oligonucleotide
cgcgggucuuguaguugcc

SEQ ID NO: 25 - RNA, 19 nt, Artificial Sequence
  Description of Artificial Sequence: Synthetic sense strand of dsRNA oligonucleotide
ccggcaagcugcccgugcc

SEQ ID NO: 26 - RNA, 19 nt, Artificial Sequence
  Description of Artificial Sequence: Synthetic antisense strand of dsRNA oligonucleotide
ggcacgggcagcuugccgg

SEQ ID NO: 27 - RNA, 19 nt, Artificial Sequence
  Description of Artificial Sequence: Synthetic sense strand of dsRNA oligonucleotide
ugcccauccuggucgagcu

SEQ ID NO: 28 - RNA, 19 nt, Artificial Sequence
  Description of Artificial Sequence: Synthetic antisense strand of dsRNA oligonucleotide
agcucgaccaggaugggca

SEQ ID NO: 29 - RNA, 19 nt, Artificial Sequence
  Description of Artificial Sequence: Synthetic sense strand of dsRNA oligonucleotide
caaguucagcguguccggc

SEQ ID NO: 30 - RNA, 19 nt, Artificial Sequence
  Description of Artificial Sequence: Synthetic antisense strand of dsRNA oligonucleotide
gccggacacgcugaacuug

SEQ ID NO: 31 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
acaugaagcagcacgacuutt

SEQ ID NO: 32 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
aagucgugcugcuucaugutt

SEQ ID NO: 33 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
gcccgacaaccacuaccugtt

SEQ ID NO: 34 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
cagguagugguugucgggctt

SEQ ID NO: 35 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
cgagaagcgcgaucacaugtt

SEQ ID NO: 36 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
caugugaucgcgcuucucgtt

SEQ ID NO: 37 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
auaucauggccgacaagcatt

SEQ ID NO: 38 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
ugcuugucggccaugauautt

SEQ ID NO: 39 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
acaagcuggaguacaacuatt

SEQ ID NO: 40 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
uaguuguacuccagcuugutt

SEQ ID NO: 41 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
gcagcucgccgaccacuactt

SEQ ID NO: 42 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
guaguggucggcgagcugctt

SEQ ID NO: 43 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
cguccaggagcgcaccauctt

SEQ ID NO: 44 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
gauggugcgcuccuggacgtt

SEQ ID NO: 45 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
gcuggaguucgugaccgcctt

SEQ ID NO: 46 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
ggcggucacgaacuccagctt

SEQ ID NO: 47 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
ccacccugaccuacggcgutt

SEQ ID NO: 48 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
acgccguaggucaggguggtt

SEQ ID NO: 49 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
cgacuucaaggaggacggctt

SEQ ID NO: 50 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
gccguccuccuugaagucgtt

SEQ ID NO: 51 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
uucaagauccgccacaacatt

SEQ ID NO: 52 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
uguuguggcggaucuugaatt

SEQ ID NO: 53 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
ggcaacuacaagacccgcgtt

SEQ ID NO: 54 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
cgcgggucuuguaguugcctt

SEQ ID NO: 55 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
ccggcaagcugcccgugcctt

SEQ ID NO: 56 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
ggcacgggcagcuugccggtt

SEQ ID NO: 57 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
ugcccauccuggucgagcutt

SEQ ID NO: 58 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
agcucgaccaggaugggcatt

SEQ ID NO: 59 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (20)..(20): deoxythimidine
  modified_base (21)..(21): deoxythimidine
caaguucagcguguccggctt

SEQ ID NO: 60 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (20)..(20): deoxythimidine
  modified_base (21)..(21): deoxythimidine
gccggacacgcugaacuugtt

SEQ ID NO: 61 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
acaugaagcagcacgacuutt

SEQ ID NO: 62 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
aagucgugcugcuucaugutt

SEQ ID NO: 63 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcccgacaaccacuaccugtt

SEQ ID NO: 64 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
cagguagugguugucgggctt

SEQ ID NO: 65 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
cgagaagcgcgaucacaugtt

SEQ ID NO: 66 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
caugugaucgcgcuucucgtt

SEQ ID NO: 67 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
auaucauggccgacaagcatt

SEQ ID NO: 68 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ugcuugucggccaugauautt

SEQ ID NO: 69 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
acaagcuggaguacaacuatt

SEQ ID NO: 70 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
uaguuguacuccagcuugutt

SEQ ID NO: 71 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcagcucgccgaccacuactt

SEQ ID NO: 72 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
guaguggucggcgagcugctt

SEQ ID NO: 73 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
cguccaggagcgcaccauctt

SEQ ID NO: 74 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
gauggugcgcuccuggacgtt

SEQ ID NO: 75 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcuggaguucgugaccgcctt

SEQ ID NO: 76 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggcggucacgaacuccagctt

SEQ ID NO: 77 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ccacccugaccuacggcgutt

SEQ ID NO: 78 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
acgccguaggucaggguggtt

SEQ ID NO: 79 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
cgacuucaaggaggacggctt

SEQ ID NO: 80 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
gccguccuccuugaagucgtt

SEQ ID NO: 81 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
uucaagauccgccacaacatt

SEQ ID NO: 82 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
uguuguggcggaucuugaatt

SEQ ID NO: 83 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ggcaacuacaagacccgcgtt

SEQ ID NO: 84 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
cgcgggucuuguaguugcctt

SEQ ID NO: 85 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ccggcaagcugcccgugcctt

SEQ ID NO: 86 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggcacgggcagcuugccggtt

SEQ ID NO: 87 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ugcccauccuggucgagcutt

SEQ ID NO: 88 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
agcucgaccaggaugggcatt

SEQ ID NO: 89 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
caaguucagcguguccggctt

SEQ ID NO: 90 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
gccggacacgcugaacuugtt

SEQ ID NO: 91 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): deoxythimidine
  modified_base (20)..(20): deoxythimidine
  misc_feature (20)..(21): phosphorothioate linkage
  modified_base (21)..(21): deoxythimidine
acaugaagcagcacgacuttt

SEQ ID NO: 92 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): deoxythimidine
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): deoxythimidine
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): deoxythimidine
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
aagtcgugctgcutcaugutt

SEQ ID NO: 93 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
gcccgacaaccacuaccugtt

SEQ ID NO: 94 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): deoxythimidine
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): deoxythimidine
  modified_base (13)..(13): 2'-O-methyl nucleoside
  modified_base (14)..(14): deoxythimidine
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
cagguagtggutgtcgggctt

SEQ ID NO: 95 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): deoxythimidine
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
cgagaagcgcgatcacaugtt

SEQ ID NO: 96 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): deoxythimidine
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): deoxythimidine
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
caugugatcgcgctucucgtt

SEQ ID NO: 97 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): deoxythimidine
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
auaucatggccgacaagcatt

SEQ ID NO: 98 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): deoxythimidine
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): deoxythimidine
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ugctugucggccatgauautt

SEQ ID NO: 99 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): deoxythimidine
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
acaagctggaguacaacuatt

SEQ ID NO: 100 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): deoxythimidine
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): deoxythimidine
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): 2'-deoxy nucleoside
  modified_base (15)..(15): 2'-O-methyl nucleoside
  modified_base (16)..(16): deoxythimidine
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
uagtuguactccagctugutt

SEQ ID NO: 101 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): deoxythimidine
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
gcagcucgccgaccactactt

SEQ ID NO: 102 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): deoxythimidine
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): deoxythimidine
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): 2'-deoxy nucleoside
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
gtaguggtcggcgagcugctt

SEQ ID NO: 103 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): deoxythimidine
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
cgtccaggagcgcaccauctt

SEQ ID NO: 104 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): deoxythimidine
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): deoxythimidine
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
gauggtgcgcucctggacgtt

SEQ ID NO: 105 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): deoxythimidine
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): deoxythimidine
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
gctggagutcgugaccgcctt

SEQ ID NO: 106 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): deoxythimidine
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): deoxythimidine
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggcggtcacgaactccagctt

SEQ ID NO: 107 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): deoxythimidine
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): deoxythimidine
  modified_base (20)..(20): deoxythimidine
  misc_feature (20)..(21): phosphorothioate linkage
  modified_base (21)..(21): deoxythimidine
ccaccctgaccuacggcgttt

SEQ ID NO: 108 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): 2'-deoxy nucleoside
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
acgccguaggucaggguggtt

SEQ ID NO: 109 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): deoxythimidine
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
cgactucaaggaggacggctt

SEQ ID NO: 110 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): deoxythimidine
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): deoxythimidine
  modified_base (13)..(13): 2'-O-methyl nucleoside
  modified_base (14)..(14): 2'-deoxy nucleoside
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
gccgucctccutgaagucgtt

SEQ ID NO: 111 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): deoxythimidine
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
tucaagauccgccacaacatt

SEQ ID NO: 112 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): deoxythimidine
  modified_base (5)..(5): 2'-O-methyl nucleoside
  modified_base (6)..(6): deoxythimidine
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): 2'-deoxy nucleoside
  modified_base (15)..(15): 2'-O-methyl nucleoside
  modified_base (16)..(16): deoxythimidine
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ugutgtggcggaucutgaatt

SEQ ID NO: 113 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): deoxythimidine
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
ggcaactacaagacccgcgtt

SEQ ID NO: 114 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): deoxythimidine
  modified_base (11)..(11): 2'-O-methyl nucleoside
  modified_base (12)..(12): deoxythimidine
  modified_base (13)..(13): 2'-O-methyl nucleoside
  modified_base (14)..(14): 2'-deoxy nucleoside
  modified_base (15)..(15): 2'-O-methyl nucleoside
  modified_base (16)..(16): deoxythimidine
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
cgcgggucutgtagutgcctt

SEQ ID NO: 115 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
ccggcaagcugcccgugcctt

SEQ ID NO: 116 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): deoxythimidine
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggcacgggcagcutgccggtt

SEQ ID NO: 117 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): deoxythimidine
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): 2'-deoxy nucleoside
  modified_base (6)..(6): 2'-O-methyl nucleoside
  modified_base (7)..(7): deoxythimidine
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): deoxythimidine
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): deoxythimidine
  modified_base (20)..(20): deoxythimidine
  misc_feature (20)..(21): phosphorothioate linkage
  modified_base (21)..(21): deoxythimidine
tgcccatccuggtcgagcttt

SEQ ID NO: 118 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): deoxythimidine
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): 2'-deoxy nucleoside
  modified_base (13)..(13): 2'-O-methyl nucleoside
  modified_base (14)..(14): deoxythimidine
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): 2'-deoxy nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
agctcgaccaggatgggcatt

SEQ ID NO: 119 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy nucleoside
  modified_base (2)..(2): 2'-O-methyl nucleoside
  modified_base (3)..(3): 2'-deoxy nucleoside
  modified_base (4)..(4): 2'-O-methyl nucleoside
  modified_base (5)..(5): deoxythimidine
  modified_base (6)..(6): 2'-O-methyl nucleoside
  modified_base (7)..(7): 2'-deoxy nucleoside
  modified_base (8)..(8): 2'-O-methyl nucleoside
  modified_base (9)..(9): 2'-deoxy nucleoside
  modified_base (10)..(10): 2'-O-methyl nucleoside
  modified_base (11)..(11): 2'-deoxy nucleoside
  modified_base (12)..(12): 2'-O-methyl nucleoside
  modified_base (13)..(13): 2'-deoxy nucleoside
  modified_base (14)..(14): 2'-O-methyl nucleoside
  modified_base (15)..(15): 2'-deoxy nucleoside
  modified_base (16)..(16): 2'-O-methyl nucleoside
  modified_base (17)..(17): 2'-deoxy nucleoside
  modified_base (18)..(18): 2'-O-methyl nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
caagtucagcguguccggctt

SEQ ID NO: 120 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy nucleoside
  modified_base (3)..(3): 2'-O-methyl nucleoside
  modified_base (4)..(4): 2'-deoxy nucleoside
  modified_base (5)..(5): 2'-O-methyl nucleoside
  modified_base (6)..(6): 2'-deoxy nucleoside
  modified_base (7)..(7): 2'-O-methyl nucleoside
  modified_base (8)..(8): 2'-deoxy nucleoside
  modified_base (9)..(9): 2'-O-methyl nucleoside
  modified_base (10)..(10): 2'-deoxy nucleoside
  modified_base (11)..(11): 2'-O-methyl nucleoside
  modified_base (12)..(12): deoxythimidine
  modified_base (13)..(13): 2'-O-methyl nucleoside
  modified_base (14)..(14): 2'-deoxy nucleoside
  modified_base (15)..(15): 2'-O-methyl nucleoside
  modified_base (16)..(16): 2'-deoxy nucleoside
  modified_base (17)..(17): 2'-O-methyl nucleoside
  modified_base (18)..(18): deoxythimidine
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
gccggacacgctgaacutgtt

SEQ ID NO: 121 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): deoxythimidine
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): deoxythimidine
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
acatgaagcagcacgactutt

SEQ ID NO: 122 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): deoxythimidine
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): deoxythimidine
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): deoxythimidine
  modified_base (18)..(18): 2'-deoxy-2'-fluoro nucleoside
  modified_base (19)..(19): deoxythimidine
  modified_base (20)..(20): deoxythimidine
  misc_feature (20)..(21): phosphorothioate linkage
  modified_base (21)..(21): deoxythimidine
aagucgtgcugctucatgttt

SEQ ID NO: 123 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): deoxythimidine
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): deoxythimidine
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcccgacaaccactacctgtt

SEQ ID NO: 124 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): deoxythimidine
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): deoxythimidine
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): 2'-deoxy nucleoside
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
caggtaguggtugucgggctt

SEQ ID NO: 125 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): deoxythimidine
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
cgagaagcgcgaucacatgtt

SEQ ID NO: 126 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): deoxythimidine
  modified_base (4)..(4): 2'-deoxy-2'-fluoro nucleoside
  modified_base (5)..(5): deoxythimidine
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): deoxythimidine
  modified_base (16)..(16): 2'-deoxy-2'-fluoro nucleoside
  modified_base (17)..(17): deoxythimidine
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
catgtgaucgcgcutctcgtt

SEQ ID NO: 127 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): deoxythimidine
  modified_base (3)..(3): 2'-deoxy-2'-fluoro nucleoside
  modified_base (4)..(4): deoxythimidine
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
atatcauggccgacaagcatt

SEQ ID NO: 128 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): deoxythimidine
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): deoxythimidine
  modified_base (6)..(6): 2'-deoxy-2'-fluoro nucleoside
  modified_base (7)..(7): deoxythimidine
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): deoxythimidine
  modified_base (18)..(18): 2'-deoxy-2'-fluoro nucleoside
  modified_base (19)..(19): deoxythimidine
  modified_base (20)..(20): deoxythimidine
  misc_feature (20)..(21): phosphorothioate linkage
  modified_base (21)..(21): deoxythimidine
tgcutgtcggccaugatattt

SEQ ID NO: 129 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): deoxythimidine
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): deoxythimidine
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
acaagcuggagtacaactatt

SEQ ID NO: 130 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): deoxythimidine
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): deoxythimidine
  modified_base (6)..(6): 2'-deoxy-2'-fluoro nucleoside
  modified_base (7)..(7): deoxythimidine
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): deoxythimidine
  modified_base (18)..(18): 2'-deoxy-2'-fluoro nucleoside
  modified_base (19)..(19): deoxythimidine
  modified_base (20)..(20): deoxythimidine
  misc_feature (20)..(21): phosphorothioate linkage
  modified_base (21)..(21): deoxythimidine
tagutgtacuccagcutgttt

SEQ ID NO: 131 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): deoxythimidine
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcagctcgccgaccacuactt

SEQ ID NO: 132 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): deoxythimidine
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): deoxythimidine
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
guagtggucggcgagctgctt

SEQ ID NO: 133 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): deoxythimidine
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
cguccaggagcgcaccatctt

SEQ ID NO: 134 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): deoxythimidine
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): deoxythimidine
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): 2'-deoxy nucleoside
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
gatggugcgctccuggacgtt

SEQ ID NO: 135 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): deoxythimidine
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): deoxythimidine
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcuggagtucgtgaccgcctt

SEQ ID NO: 136 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): 2'-deoxy nucleoside
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
ggcggucacgaacuccagctt

SEQ ID NO: 137 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): deoxythimidine
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ccacccugacctacggcgutt

SEQ ID NO: 138 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): deoxythimidine
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): deoxythimidine
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): deoxythimidine
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
acgccgtaggtcagggtggtt

SEQ ID NO: 139 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): deoxythimidine
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
cgacutcaaggaggacggctt

SEQ ID NO: 140 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): deoxythimidine
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): deoxythimidine
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): deoxythimidine
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
gccgtccucctugaagtcgtt

SEQ ID NO: 141 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): deoxythimidine
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): deoxythimidine
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
utcaagatccgccacaacatt

SEQ ID NO: 142 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): deoxythimidine
  modified_base (2)..(2): 2'-deoxy-2'-fluoro nucleoside
  modified_base (3)..(3): deoxythimidine
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): deoxythimidine
  modified_base (14)..(14): 2'-deoxy-2'-fluoro nucleoside
  modified_base (15)..(15): deoxythimidine
  modified_base (16)..(16): 2'-deoxy-2'-fluoro nucleoside
  modified_base (17)..(17): 2'-deoxy nucleoside
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
tgtuguggcggatctugaatt

SEQ ID NO: 143 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ggcaacuacaagacccgcgtt

SEQ ID NO: 144 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): deoxythimidine
  modified_base (8)..(8): 2'-deoxy-2'-fluoro nucleoside
  modified_base (9)..(9): deoxythimidine
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): deoxythimidine
  modified_base (16)..(16): 2'-deoxy-2'-fluoro nucleoside
  modified_base (17)..(17): 2'-deoxy nucleoside
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
cgcgggtctuguagtugcctt

SEQ ID NO: 145 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): deoxythimidine
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): deoxythimidine
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ccggcaagctgcccgtgcctt

SEQ ID NO: 146 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): deoxythimidine
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): 2'-deoxy nucleoside
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
ggcacgggcagctugccggtt

SEQ ID NO: 147 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): 2'-deoxy nucleoside
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): deoxythimidine
  modified_base (11)..(11): 2'-deoxy-2'-fluoro nucleoside
  modified_base (12)..(12): 2'-deoxy nucleoside
  modified_base (13)..(13): 2'-deoxy-2'-fluoro nucleoside
  modified_base (14)..(14): 2'-deoxy nucleoside
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ugcccaucctggucgagcutt

SEQ ID NO: 148 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): 2'-deoxy nucleoside
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
agcucgaccaggaugggcatt

SEQ ID NO: 149 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-deoxy nucleoside
  modified_base (3)..(3): 2'-deoxy-2'-fluoro nucleoside
  modified_base (4)..(4): 2'-deoxy nucleoside
  modified_base (5)..(5): 2'-deoxy-2'-fluoro nucleoside
  modified_base (6)..(6): deoxythimidine
  modified_base (7)..(7): 2'-deoxy-2'-fluoro nucleoside
  modified_base (8)..(8): 2'-deoxy nucleoside
  modified_base (9)..(9): 2'-deoxy-2'-fluoro nucleoside
  modified_base (10)..(10): 2'-deoxy nucleoside
  modified_base (11)..(11): 2'-deoxy-2'-fluoro nucleoside
  modified_base (12)..(12): deoxythimidine
  modified_base (13)..(13): 2'-deoxy-2'-fluoro nucleoside
  modified_base (14)..(14): deoxythimidine
  modified_base (15)..(15): 2'-deoxy-2'-fluoro nucleoside
  modified_base (16)..(16): 2'-deoxy nucleoside
  modified_base (17)..(17): 2'-deoxy-2'-fluoro nucleoside
  modified_base (18)..(18): 2'-deoxy nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
caagutcagcgtgtccggctt

SEQ ID NO: 150 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy nucleoside
  modified_base (2)..(2): 2'-deoxy-2'-fluoro nucleoside
  modified_base (3)..(3): 2'-deoxy nucleoside
  modified_base (4)..(4): 2'-deoxy-2'-fluoro nucleoside
  modified_base (5)..(5): 2'-deoxy nucleoside
  modified_base (6)..(6): 2'-deoxy-2'-fluoro nucleoside
  modified_base (7)..(7): 2'-deoxy nucleoside
  modified_base (8)..(8): 2'-deoxy-2'-fluoro nucleoside
  modified_base (9)..(9): 2'-deoxy nucleoside
  modified_base (10)..(10): 2'-deoxy-2'-fluoro nucleoside
  modified_base (11)..(11): 2'-deoxy nucleoside
  modified_base (12)..(12): 2'-deoxy-2'-fluoro nucleoside
  modified_base (13)..(13): 2'-deoxy nucleoside
  modified_base (14)..(14): 2'-deoxy-2'-fluoro nucleoside
  modified_base (15)..(15): 2'-deoxy nucleoside
  modified_base (16)..(16): 2'-deoxy-2'-fluoro nucleoside
  modified_base (17)..(17): deoxythimidine
  modified_base (18)..(18): 2'-deoxy-2'-fluoro nucleoside
  modified_base (19)..(19): 2'-deoxy nucleoside
  modified_base (20)..(20): deoxythimidine
  misc_feature (20)..(21): phosphorothioate linkage
  modified_base (21)..(21): deoxythimidine
gccggacacgcugaactugtt

SEQ ID NO: 151 - RNA, 21 nt, Artificial Sequence
  Description of Artificial Sequence: Synthetic oligonucleotide sense strand of dsRNA targeting apoB
ggaaucuuauauuugauccaa

SEQ ID NO: 152 - RNA, 23 nt, Artificial Sequence
  Description of Artificial Sequence: Synthetic oligonucleotide antisense strand of dsRNA targeting apoB
uuggaucaaauauaagauucccu

SEQ ID NO: 153 - RNA, 21 nt, Artificial Sequence
  Description of Artificial Sequence: Synthetic oligonucleotide sense strand of dsRNA targeting apoB
  modified_base (7)..(7): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (14)..(14): 2'-O-methyl nucleoside
  modified_base (19)..(19): 2'-O-methyl nucleoside
  misc_feature (20)..(21): phosphorothioate linkage
ggaaucuuauauuugauccaa

SEQ ID NO: 154 - RNA, 23 nt, Artificial Sequence
  Description of Artificial Sequence: Synthetic oligonucleotide antisense strand of dsRNA targeting apoB
  modified_base (1)..(1): 2'-O-methyl nucleoside
  modified_base (2)..(2): 2'-O-methyl nucleoside
  modified_base (7)..(7): 2'-O-methyl nucleoside
  modified_base (11)..(11): 2'-O-methyl nucleoside
  modified_base (13)..(13): 2'-O-methyl nucleoside
  modified_base (18)..(18): 2'-O-methyl nucleoside
  modified_base (21)..(21): 2'-O-methyl nucleoside
  misc_feature (21)..(22): phosphorothioate linkage
  modified_base (22)..(22): 2'-O-methyl nucleoside
  misc_feature (22)..(23): phosphorothioate linkage
uuggaucaaauauaagauucccu

SEQ ID NO: 155 - RNA, 19 nt, Artificial Sequence
  Description of Artificial Sequence: Synthetic oligonucleotide sense strand of dsRNA targeting aha1
ggaugaaguggagauuagu

SEQ ID NO: 156 - RNA, 19 nt, Artificial Sequence
  Description of Artificial Sequence: Synthetic oligonucleotide antisense strand of dsRNA targeting aha1
acuaaucuccacuucaucc

SEQ ID NO: 157 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (4)..(4): 2'-O-methyl nucleoside
  modified_base (9)..(9): 2'-O-methyl nucleoside
  modified_base (15)..(15): 2'-O-methyl nucleoside
  modified_base (16)..(16): 2'-O-methyl nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggaugaaguggagauuagutt

SEQ ID NO: 158 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  modified_base (3)..(3): 2'-O-methyl nucleoside
  modified_base (10)..(10): 2'-O-methyl nucleoside
  modified_base (15)..(15): 2'-O-methyl nucleoside
  modified_base (20)..(20): deoxythimidine
  misc_feature (20)..(21): phosphorothioate linkage
  modified_base (21)..(21): deoxythimidine
acuaaucuccacuucaucctt

SEQ ID NO: 159 - DNA, 20 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  5'-phosphate
  modified_base (1)..(1): 2'-O-methyl nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
acuaaucuccacuucaucct

SEQ ID NO: 160 - DNA, 20 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  5'-aminohexyl linker
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
ggaugaaguggagauuagut

SEQ ID NO: 161 - RNA, 19 nt, Artificial Sequence
  Description of Artificial Sequence: Synthetic sense strand of dsRNA oligonucleotide
gcaaaggcgugccaacuca

SEQ ID NO: 162 - RNA, 19 nt, Artificial Sequence
  Description of Artificial Sequence: Synthetic antisense strand of dsRNA oligonucleotide
ugaguuggcacgccuuugc

SEQ ID NO: 163 - RNA, 19 nt, Artificial Sequence
  Description of Artificial Sequence: Synthetic sense strand of dsRNA oligonucleotide
ggaucaucucaagucuuac

SEQ ID NO: 164 - RNA, 19 nt, Artificial Sequence
  Description of Artificial Sequence: Synthetic antisense strand of dsRNA oligonucleotide
guaagacuugagaugaucc

SEQ ID NO: 165 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-aminohexyl linker
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcaaaggcgugccaacucat

SEQ ID NO: 166 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 167 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-aminohexyl linker
  modified_base (2)..(2): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (16)..(16): 2'-O-methyl nucleoside
  modified_base (17)..(17): 2'-O-methyl nucleoside
  modified_base (18)..(18): 2'-O-methyl nucleoside
  modified_base (20)..(20): deoxythimidine
  misc_feature (20)..(21): phosphorothioate linkage
  modified_base (21)..(21): deoxythimidine
gcaaaggcgugccaacucatt

SEQ ID NO: 168 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (9)..(9): 2'-O-methyl nucleoside
  modified_base (20)..(20): deoxythimidine
  misc_feature (20)..(21): phosphorothioate linkage
  modified_base (21)..(21): deoxythimidine
ugaguuggcacgccuuugctt

SEQ ID NO: 169 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-aminohexyl linker
  modified_base (4)..(4): 2'-deoxy-2'-fluoro nucleoside
  modified_base (5)..(5): 2'-deoxy-2'-fluoro nucleoside
  modified_base (7)..(7): 2'-deoxy-2'-fluoro nucleoside
  modified_base (8)..(8): 2'-deoxy-2'-fluoro nucleoside
  modified_base (9)..(9): 2'-deoxy-2'-fluoro nucleoside
  modified_base (10)..(10): 2'-deoxy-2'-fluoro nucleoside
  modified_base (14)..(14): 2'-deoxy-2'-fluoro nucleoside
  modified_base (15)..(15): 2'-deoxy-2'-fluoro nucleoside
  modified_base (16)..(16): 2'-deoxy-2'-fluoro nucleoside
  modified_base (17)..(17): 2'-deoxy-2'-fluoro nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ggaucaucucaagucuuactt

SEQ ID NO: 170 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (2)..(2): 2'-deoxy-2'-fluoro nucleoside
  modified_base (7)..(7): 2'-deoxy-2'-fluoro nucleoside
  modified_base (8)..(8): 2'-deoxy-2'-fluoro nucleoside
  modified_base (9)..(9): 2'-deoxy-2'-fluoro nucleoside
  modified_base (14)..(14): 2'-deoxy-2'-fluoro nucleoside
  modified_base (17)..(17): 2'-deoxy-2'-fluoro nucleoside
  modified_base (18)..(18): 2'-deoxy-2'-fluoro nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
guaagacuugagaugaucctt

SEQ ID NO: 171 - RNA, 19 nt, Artificial Sequence
  Description of Artificial Sequence: Synthetic oligonucleotide sense strand of dsRNA targeting PTPN1
ugaccacagucggauuaaa

SEQ ID NO: 172 - RNA, 19 nt, Artificial Sequence
  Description of Artificial Sequence: Synthetic oligonucleotide antisense strand of dsRNA targeting PTPN1
uuuaauccgacugugguca

SEQ ID NO: 173 - DNA, 20 bp, Artificial Sequence
  Description of Artificial Sequence: Synthetic oligonucleotide sense strand of dsRNA targeting PTPN1
  Description of Combined DNA/RNA Molecule: Synthetic oligonucleotide sense strand of dsRNA targeting PTPN1
  5'-aminohexyl linker
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
ugaccacagucggauuaaat

SEQ ID NO: 174 - DNA, 20 bp, Artificial Sequence
  Description of Artificial Sequence: Synthetic oligonucleotide antisense strand of dsRNA targeting PTPN1
  Description of Combined DNA/RNA Molecule: Synthetic oligonucleotide antisense strand of dsRNA targeting PTPN1
  5'-phosphate
  modified_base (1)..(1): 2'-O-methyl nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
uuuaauccgacuguggucat

SEQ ID NO: 175 - DNA, 21 bp, Artificial Sequence
  Description of Artificial Sequence: Synthetic oligonucleotide sense strand of dsRNA targeting PTPN1
  Description of Combined DNA/RNA Molecule: Synthetic oligonucleotide sense strand of dsRNA targeting PTPN1
  5'-aminohexyl linker
  modified_base (1)..(1): 2'-O-methyl nucleoside
  modified_base (4)..(4): 2'-O-methyl nucleoside
  modified_base (5)..(5): 2'-O-methyl nucleoside
  modified_base (7)..(7): 2'-O-methyl nucleoside
  modified_base (10)..(10): 2'-O-methyl nucleoside
  modified_base (11)..(11): 2'-O-methyl nucleoside
  modified_base (15)..(15): 2'-O-methyl nucleoside
  modified_base (16)..(16): 2'-O-methyl nucleoside
  modified_base (20)..(20): deoxythimidine
  misc_feature (20)..(21): phosphorothioate linkage
  modified_base (21)..(21): deoxythimidine
ugaccacagucggauuaaatt

SEQ ID NO: 176 - DNA, 21 bp, Artificial Sequence
  Description of Artificial Sequence: Synthetic oligonucleotide antisense strand of dsRNA targeting PTPN1
  Description of Combined DNA/RNA Molecule: Synthetic oligonucleotide antisense strand of dsRNA targeting PTPN1
  5'-phosphate
  modified_base (1)..(1): 2'-O-methyl nucleoside
  modified_base (3)..(3): 2'-O-methyl nucleoside
  modified_base (17)..(17): 2'-O-methyl nucleoside
  modified_base (18)..(18): 2'-O-methyl nucleoside
  modified_base (20)..(20): deoxythimidine
  misc_feature (20)..(21): phosphorothioate linkage
  modified_base (21)..(21): deoxythimidine
uuuaauccgacuguggucatt

SEQ ID NO: 177 - DNA, 21 bp, Artificial Sequence
  Description of Artificial Sequence: Synthetic oligonucleotide antisense strand of dsRNA targeting PTPN1
  Description of Combined DNA/RNA Molecule: Synthetic oligonucleotide antisense strand of dsRNA targeting PTPN1
  modified_base (3)..(3): 2'-O-methyl nucleoside
  modified_base (18)..(18): 2'-O-methyl nucleoside
  modified_base (20)..(20): deoxythimidine
  misc_feature (20)..(21): phosphorothioate linkage
  modified_base (21)..(21): deoxythimidine
uuuaauccgacuguggucatt

SEQ ID NO: 178 - DNA, 19 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
tgaguuggcacgccuuugc

SEQ ID NO: 179 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-GalNAc-aminohexyl linker
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcaaaggcgugccaacucat

SEQ ID NO: 180 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-GalNAc-aminohexyl linker
  modified_base (2)..(2): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (16)..(16): 2'-O-methyl nucleoside
  modified_base (17)..(17): 2'-O-methyl nucleoside
  modified_base (18)..(18): 2'-O-methyl nucleoside
  modified_base (20)..(20): deoxythimidine
  misc_feature (20)..(21): phosphorothioate linkage
  modified_base (21)..(21): deoxythimidine
gcaaaggcgugccaacucatt

SEQ ID NO: 181 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcaaaggcgugccaacucat

SEQ ID NO: 182 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (2)..(2): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (16)..(16): 2'-O-methyl nucleoside
  modified_base (17)..(17): 2'-O-methyl nucleoside
  modified_base (18)..(18): 2'-O-methyl nucleoside
  modified_base (20)..(20): deoxythimidine
  misc_feature (20)..(21): phosphorothioate linkage
  modified_base (21)..(21): deoxythimidine
gcaaaggcgugccaacucatt

SEQ ID NO: 183 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-Chol
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcaaaggcgugccaacucat

SEQ ID NO: 184 - DNA, 19 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
gcaaaggcgugccaacuca

SEQ ID NO: 185 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 186 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate-monophosphorthioate
  modified_base (1)..(1): deoxythimidine
  modified_base (2)..(2): 2'-deoxy nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 187 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate-monophosphorthioate
  modified_base (1)..(1): deoxythimidine
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 188 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): deoxythimidine
  misc_feature (1)..(2): phosphorothioate linkage
  modified_base (2)..(2): 2'-deoxy nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 189 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): deoxythimidine
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 190 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-O-methyl nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 191 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate-monophosphorthioate
  modified_base (1)..(1): 2'-deoxy-2'-fluoro nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 192 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 193 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate-monophosphorthioate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 194 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate-monophosphorthioate
  modified_base (1)..(1): deoxythimidine
  misc_feature (1)..(2): phosphorothioate linkage
  modified_base (2)..(2): 2'-deoxy nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 195 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (1)..(1): 2'-O-methyl nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 196 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 197 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (1)..(1): deoxythimidine
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 198 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate-monophosphorthioate
  modified_base (1)..(1): deoxythimidine
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 199 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  modified_base (1)..(1): deoxythimidine
  misc_feature (1)..(2): phosphorothioate linkage
  modified_base (2)..(2): 2'-deoxy nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 200 - DNA, 20 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-O-methyl nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcuggaguucgugaccgcct

SEQ ID NO: 201 - DNA, 20 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-O-methyl nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcuggaguucgugaccgcct

SEQ ID NO: 202 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-O-methyl nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcuggaguucgugaccgcctt

SEQ ID NO: 203 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-O-methyl nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcuggaguucgugaccgcctt

SEQ ID NO: 204 - DNA, 20 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcuggaguucgugaccgcct

SEQ ID NO: 205 - DNA, 20 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-deoxy-2'-fluoro nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcuggaguucgugaccgcct

SEQ ID NO: 206 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcuggaguucgugaccgcctt

SEQ ID NO: 207 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  modified_base (21)..(21): inverted deoxythimidine
gcuggaguucgugaccgcctt

SEQ ID NO: 208 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-O-methyl nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  modified_base (21)..(21): inverted deoxythimidine
gcuggaguucgugaccgcctt

SEQ ID NO: 209 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-deoxy-2'-fluoro nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
gcuggaguucgugaccgcctt

SEQ ID NO: 210 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-deoxy-2'-fluoro nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  modified_base (21)..(21): inverted deoxythimidine
gcuggaguucgugaccgcctt

SEQ ID NO: 211 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (1)..(1): 2'-O-methyl nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  modified_base (21)..(21): inverted deoxythimidine
gcuggaguucgugaccgcctt

SEQ ID NO: 212 - DNA, 21 bp, Artificial Sequence
  Description of Artificial Sequence: Synthetic oligonucleotide sense strand of dsRNA targeting EGFP
  Description of Combined DNA/RNA Molecule: Synthetic oligonucleotide sense strand of dsRNA targeting EGFP
  modified_base (2)..(2): 2'-O-methyl nucleoside
  modified_base (3)..(3): 2'-O-methyl nucleoside
  modified_base (8)..(8): 2'-O-methyl nucleoside
  modified_base (9)..(9): 2'-O-methyl nucleoside
  modified_base (10)..(10): 2'-O-methyl nucleoside
  modified_base (12)..(12): 2'-O-methyl nucleoside
  modified_base (15)..(15): 2'-O-methyl nucleoside
  modified_base (16)..(16): 2'-O-methyl nucleoside
  modified_base (18)..(18): 2'-O-methyl nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
gcuggaguucgugaccgcctt

SEQ ID NO: 213 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  5'-phosphate
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggcggucacgaacuccagctt

SEQ ID NO: 214 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggcggucacgaacuccagctt

SEQ ID NO: 215 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggcggucacgaacuccagctt

SEQ ID NO: 216 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
ggcggucacgaacuccagctt

SEQ ID NO: 217 - DNA, 20 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  5'-phosphate
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ggcggucacgaacuccagct

SEQ ID NO: 218 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  modified_base (21)..(21): inverted deoxythimidine
ggcggucacgaacuccagctt

SEQ ID NO: 219 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  5'-phosphate
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  modified_base (21)..(21): inverted deoxythimidine
ggcggucacgaacuccagctt

SEQ ID NO: 220 - DNA, 20 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ggcggucacgaacuccagct

SEQ ID NO: 221 - DNA, 20 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ggcggucacgaacuccagct

SEQ ID NO: 222 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  modified_base (21)..(21): inverted deoxythimidine
ggcggucacgaacuccagctt

SEQ ID NO: 223 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  modified_base (21)..(21): inverted deoxythimidine
ggcggucacgaacuccagctt

SEQ ID NO: 224 - DNA, 20 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ggcggucacgaacuccagct

SEQ ID NO: 225 - DNA, 21 bp, Artificial Sequence
  Description of Artificial Sequence: Synthetic oligonucleotide antisense strand of dsRNA targeting EGFP
  Description of Combined DNA/RNA Molecule: Synthetic oligonucleotide antisense strand of dsRNA targeting EGFP
  modified_base (7)..(7): 2'-O-methyl nucleoside
  modified_base (16)..(16): 2'-O-methyl nucleoside
  modified_base (20)..(20): deoxythimidine
  misc_feature (20)..(21): phosphorothioate linkage
  modified_base (21)..(21): deoxythimidine
ggcggucacgaacuccagctt

SEQ ID NO: 226 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-O-methyl nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ggaugaaguggagauuagutt

SEQ ID NO: 227 - DNA, 20 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-O-methyl nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
ggaugaaguggagauuagut

SEQ ID NO: 228 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-deoxy-2'-fluoro nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ggaugaaguggagauuagutt

SEQ ID NO: 229 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-deoxy-2'-fluoro nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  modified_base (21)..(21): inverted deoxythimidine
ggaugaaguggagauuagutt

SEQ ID NO: 230 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-O-methyl nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ggaugaaguggagauuagutt

SEQ ID NO: 231 - DNA, 20 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-deoxy-2'-fluoro nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
ggaugaaguggagauuagut

SEQ ID NO: 232 - DNA, 20 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-O-methyl nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
ggaugaaguggagauuagut

SEQ ID NO: 233 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  modified_base (21)..(21): inverted deoxythimidine
ggaugaaguggagauuagutt

SEQ ID NO: 234 - DNA, 20 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
ggaugaaguggagauuagut

SEQ ID NO: 235 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-O-methyl nucleoside
  misc_feature (1)..(2): phosphorothioate linkage
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  modified_base (21)..(21): inverted deoxythimidine
ggaugaaguggagauuagutt

SEQ ID NO: 236 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  misc_feature (20)..(21): phosphorothioate linkage
  modified_base (21)..(21): deoxythimidine
ggaugaaguggagauuagutt

SEQ ID NO: 237 - DNA, 21 bp, Artificial Sequence
  Description of Artificial Sequence: Synthetic oligonucleotide sense strand of dsRNA targeting aha1
  Description of Combined DNA/RNA Molecule: Synthetic oligonucleotide sense strand of dsRNA targeting aha1
  modified_base (1)..(1): 2'-O-methyl nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): deoxythimidine
  modified_base (21)..(21): inverted deoxythimidine
ggaugaaguggagauuagutt

SEQ ID NO: 238 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
acuaaucuccacuucaucctt

SEQ ID NO: 239 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  modified_base (21)..(21): inverted deoxythimidine
acuaaucuccacuucaucctt

SEQ ID NO: 240 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
acuaaucuccacuucaucctt

SEQ ID NO: 241 - DNA, 20 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
acuaaucuccacuucaucct

SEQ ID NO: 242 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  5'-phosphate
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  modified_base (21)..(21): inverted deoxythimidine
acuaaucuccacuucaucctt

SEQ ID NO: 243 - DNA, 20 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  5'-phosphate
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
acuaaucuccacuucaucct

SEQ ID NO: 244 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  modified_base (21)..(21): inverted deoxythimidine
acuaaucuccacuucaucctt

SEQ ID NO: 245 - DNA, 20 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
acuaaucuccacuucaucct

SEQ ID NO: 246 - DNA, 20 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
acuaaucuccacuucaucct

SEQ ID NO: 247 - RNA, 19 nt, Artificial Sequence
  Description of Artificial Sequence: Synthetic sense strand of dsRNA oligonucleotide
guuggugaauggagcucag

SEQ ID NO: 248 - RNA, 19 nt, Artificial Sequence
  Description of Artificial Sequence: Synthetic antisense strand of dsRNA oligonucleotide
cugagcuccauucaccaac

SEQ ID NO: 249 - RNA, 19 nt, Artificial Sequence
  Description of Artificial Sequence: Synthetic sense strand of dsRNA oligonucleotide
gguccuguuguuggugaau

SEQ ID NO: 250 - RNA, 19 nt, Artificial Sequence
  Description of Artificial Sequence: Synthetic antisense strand of dsRNA oligonucleotide
auucaccaacaacaggacc

SEQ ID NO: 251 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-aminohexyl linker
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
guuggugaauggagcucagt

SEQ ID NO: 252 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
cugagcuccauucaccaact

SEQ ID NO: 253 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-aminohexyl linker
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gguccuguuguuggugaaut

SEQ ID NO: 254 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
auucaccaacaacaggacctt

SEQ ID NO: 255 - DNA, 21 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
cugagcuccauucaccaactt

SEQ ID NO: 256 - RNA, 22 nt, Artificial Sequence
  Description of Artificial Sequence: Synthetic antisense strand of dsRNA oligonucleotide
uaugcaaaggcgugccaacuca

SEQ ID NO: 257 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-Chol-phosphate
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcaaaggcgugccaacucat

SEQ ID NO: 258 - DNA, 21 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-Chol-phosphate
  modified_base (2)..(2): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (16)..(16): 2'-O-methyl nucleoside
  modified_base (17)..(17): 2'-O-methyl nucleoside
  modified_base (18)..(18): 2'-O-methyl nucleoside
  modified_base (20)..(20): deoxythimidine
  misc_feature (20)..(21): phosphorothioate linkage
  modified_base (21)..(21): deoxythimidine
gcaaaggcgugccaacucatt

SEQ ID NO: 259 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-Chol-C6SSC6
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcaaaggcgugccaacucat

SEQ ID NO: 260 - DNA, 23 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-Chol
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): 2'-deoxy-2'-fluoro nucleoside
  modified_base (21)..(21): 2'-O-methyl nucleoside
  modified_base (22)..(22): 2'-deoxy-2'-fluoro nucleoside
  modified_base (23)..(23): inverted deoxythimidine
aucgcaaaggcgugccaacucat

SEQ ID NO: 261 - DNA, 20 bp, Artificial Sequence
  Description of Artificial Sequence: Synthetic sense strand of dsRNA oligonucleotide
  Description of Combined DNA/RNA Molecule: Synthetic sense strand of dsRNA oligonucleotide
  5'-Chol-Cathepsin-aminohexyl linker-phosphate
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): inverted deoxythimidine
gcaaaggcgugccaacucat

SEQ ID NO: 262 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 263 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate-monophosphorthioate
  modified_base (1)..(1): deoxythimidine
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
tgaguuggcacgccuuugct

SEQ ID NO: 264 - DNA, 20 bp, Artificial Sequence
  Description of Artificial Sequence: Synthetic antisense strand of dsRNA oligonucleotide
  Description of Combined DNA/RNA Molecule: Synthetic antisense strand of dsRNA oligonucleotide
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): inverted deoxythimidine
ugaguuggcacgccuuugct

SEQ ID NO: 265 - RNA, 21 nt, Artificial Sequence
  Description of Artificial Sequence: Synthetic oligonucleotide sense strand of dsRNA targeting apoB
  5'-Chol-phosphate
  modified_base (7)..(7): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (14)..(14): 2'-O-methyl nucleoside
  modified_base (19)..(19): 2'-O-methyl nucleoside
  misc_feature (20)..(21): phosphorothioate linkage
ggaaucuuauauuugauccaa

SEQ ID NO: 266 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  5'-phosphate
  modified_base (1)..(1): 2'-deoxy nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
acuaaucuccacuucaucctt

SEQ ID NO: 267 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
acuaaucuccacuucaucctt

SEQ ID NO: 268 - DNA, 21 bp, Artificial Sequence
  Description of Artificial Sequence: Synthetic oligonucleotide antisense strand of dsRNA targeting aha1
  Description of Combined DNA/RNA Molecule: Synthetic oligonucleotide antisense strand of dsRNA targeting aha1
  5'-phosphate
  modified_base (1)..(1): 2'-deoxy-2'-fluoro nucleoside
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  modified_base (21)..(21): inverted deoxythimidine
acuaaucuccacuucaucctt

SEQ ID NO: 269 - DNA, 17 bp, Artificial Sequence
  Description of Artificial Sequence: Synthetic PNA probe for detection of SEQ ID NO: 182 (sense strand)
  5'-Atto425-OO
tgagttggcacgccttt

SEQ ID NO: 270 - DNA, 17 bp, Artificial Sequence
  Description of Artificial Sequence: Synthetic PNA probe for detection of SEQ ID NO: 168 (antisense strand)
  5'-Atto425-OO
gcaaaggcgtgccaact

SEQ ID NO: 271 - RNA, 22 nt, Artificial Sequence
  Description of Artificial Sequence: Synthetic oligonucleotide sense strand of dsRNA targeting FVII
ugugcaaaggcgugccaacuca

SEQ ID NO: 272 - RNA, 23 nt, Artificial Sequence
  Description of Artificial Sequence: Synthetic oligonucleotide sense strand of dsRNA targeting FVII
uauugcaaaggcgugccaacuca

SEQ ID NO: 273 - RNA, 23 nt, Artificial Sequence
  Description of Artificial Sequence: Synthetic oligonucleotide sense strand of dsRNA targeting FVII
uguugcaaaggcgugccaacuca

SEQ ID NO: 274 - RNA, 23 nt, Artificial Sequence
  Description of Artificial Sequence: Synthetic oligonucleotide sense strand of dsRNA targeting FVII
uuaggcaaaggcgugccaacuca

SEQ ID NO: 275 - RNA, 23 nt, Artificial Sequence
  Description of Artificial Sequence: Synthetic oligonucleotide sense strand of dsRNA targeting FVII
uagugcaaaggcgugccaacuca

SEQ ID NO: 276 - DNA, 23 bp, Artificial Sequence
  Description of Artificial Sequence: Synthetic oligonucleotide antisense strand of dsRNA targeting FVII
  Description of Combined DNA/RNA Molecule: Synthetic oligonucleotide antisense strand of dsRNA targeting FVII
  5'-Chol
  modified_base (1)..(1): 2'-O-methyl nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): 2'-deoxy-2'-fluoro nucleoside
  modified_base (21)..(21): 2'-O-methyl nucleoside
  modified_base (22)..(22): 2'-deoxy-2'-fluoro nucleoside
  modified_base (23)..(23): inverted deoxythimidine
uaugcaaaggcgugccaacucat

SEQ ID NO: 277 - DNA, 23 bp, Artificial Sequence
  Description of Artificial Sequence: Synthetic oligonucleotide antisense strand of dsRNA targeting FVII
  Description of Combined DNA/RNA Molecule: Synthetic oligonucleotide antisense strand of dsRNA targeting FVII
  5'-Chol
  modified_base (1)..(1): 2'-O-methyl nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): 2'-deoxy-2'-fluoro nucleoside
  modified_base (21)..(21): 2'-O-methyl nucleoside
  modified_base (22)..(22): 2'-deoxy-2'-fluoro nucleoside
  modified_base (23)..(23): inverted deoxythimidine
ugugcaaaggcgugccaacucat

SEQ ID NO: 278 - DNA, 24 bp, Artificial Sequence
  Description of Artificial Sequence: Synthetic oligonucleotide antisense strand of dsRNA targeting FVII
  Description of Combined DNA/RNA Molecule: Synthetic oligonucleotide antisense strand of dsRNA targeting FVII
  5'-Chol
  modified_base (1)..(1): 2'-O-methyl nucleoside
  modified_base (3)..(3): 2'-O-methyl nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): 2'-O-methyl nucleoside
  modified_base (21)..(21): 2'-deoxy-2'-fluoro nucleoside
  modified_base (22)..(22): 2'-O-methyl nucleoside
  modified_base (23)..(23): 2'-deoxy-2'-fluoro nucleoside
  modified_base (24)..(24): inverted deoxythimidine
uauugcaaaggcgugccaacucat

SEQ ID NO: 279 - DNA, 24 bp, Artificial Sequence
  Description of Artificial Sequence: Synthetic oligonucleotide antisense strand of dsRNA targeting FVII
  Description of Combined DNA/RNA Molecule: Synthetic oligonucleotide antisense strand of dsRNA targeting FVII
  5'-Chol
  modified_base (1)..(1): 2'-O-methyl nucleoside
  modified_base (3)..(3): 2'-O-methyl nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): 2'-O-methyl nucleoside
  modified_base (21)..(21): 2'-deoxy-2'-fluoro nucleoside
  modified_base (22)..(22): 2'-O-methyl nucleoside
  modified_base (23)..(23): 2'-deoxy-2'-fluoro nucleoside
  modified_base (24)..(24): inverted deoxythimidine
uguugcaaaggcgugccaacucat

SEQ ID NO: 280 - DNA, 24 bp, Artificial Sequence
  Description of Artificial Sequence: Synthetic oligonucleotide antisense strand of dsRNA targeting FVII
  Description of Combined DNA/RNA Molecule: Synthetic oligonucleotide antisense strand of dsRNA targeting FVII
  5'-Chol
  modified_base (1)..(1): 2'-O-methyl nucleoside
  modified_base (2)..(2): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): 2'-O-methyl nucleoside
  modified_base (21)..(21): 2'-deoxy-2'-fluoro nucleoside
  modified_base (22)..(22): 2'-O-methyl nucleoside
  modified_base (23)..(23): 2'-deoxy-2'-fluoro nucleoside
  modified_base (24)..(24): inverted deoxythimidine
uuaggcaaaggcgugccaacucat

SEQ ID NO: 281 - DNA, 24 bp, Artificial Sequence
  Description of Artificial Sequence: Synthetic oligonucleotide antisense strand of dsRNA targeting FVII
  Description of Combined DNA/RNA Molecule: Synthetic oligonucleotide antisense strand of dsRNA targeting FVII
  5'-Chol
  modified_base (1)..(1): 2'-O-methyl nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  modified_base (20)..(20): 2'-O-methyl nucleoside
  modified_base (21)..(21): 2'-deoxy-2'-fluoro nucleoside
  modified_base (22)..(22): 2'-O-methyl nucleoside
  modified_base (23)..(23): 2'-deoxy-2'-fluoro nucleoside
  modified_base (24)..(24): inverted deoxythimidine
uagugcaaaggcgugccaacucat

SEQ ID NO: 282 - DNA, 21 bp, Artificial Sequence
  Description of Artificial Sequence: Synthetic oligonucleotide antisense strand of dsRNA targeting FVII
  Description of Combined DNA/RNA Molecule: Synthetic oligonucleotide antisense strand of dsRNA targeting FVII
  5'-phosphate
  modified_base (1)..(1): deoxythimidine
  misc_feature (1)..(2): phosphorothioate linkage
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  modified_base (20)..(20): deoxythimidine
  misc_feature (20)..(21): phosphorothioate linkage
  modified_base (21)..(21): deoxythimidine
tgaguuggcacgccuuugctt

SEQ ID NO: 283 - RNA, 21 nt, Artificial Sequence
  Description of Artificial Sequence: Synthetic oligonucleotide
  5'-aminohexyl linker
  modified_base (7)..(7): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (14)..(14): 2'-O-methyl nucleoside
  modified_base (19)..(19): 2'-O-methyl nucleoside
  misc_feature (20)..(21): phosphorothioate linkage
ggaaucuuauauuugauccaa

SEQ ID NO: 284 - RNA, 21 nt, Artificial Sequence
  Description of Artificial Sequence: Synthetic oligonucleotide
  5'-aminohexyl linker
  modified_base (7)..(7): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (14)..(14): 2'-O-methyl nucleoside
  modified_base (19)..(19): 2'-O-methyl nucleoside
  misc_feature (20)..(21): phosphorothioate linkage
ggaaucuuauauuugauccaa

SEQ ID NO: 285 - RNA, 21 nt, Artificial Sequence
  Description of Artificial Sequence: Synthetic oligonucleotide
  5'-Chol
  modified_base (7)..(7): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (13)..(13): 2'-O-methyl nucleoside
  modified_base (14)..(14): 2'-O-methyl nucleoside
  modified_base (19)..(19): 2'-O-methyl nucleoside
  misc_feature (20)..(21): phosphorothioate linkage
ggaaucuuauauuugauccaa

SEQ ID NO: 286 - DNA, 21 bp, Artificial Sequence
  Description of Artificial Sequence: Synthetic oligonucleotide
  Description of Combined DNA/RNA Molecule: Synthetic oligonucleotide
ugcccauccuggucgagcutt

SEQ ID NO: 287 - DNA, 21 bp, Artificial Sequence
  Description of Artificial Sequence: Synthetic oligonucleotide
  Description of Combined DNA/RNA Molecule: Synthetic oligonucleotide
  5'-phosphate
agcucgaccaggaugggcatt

SEQ ID NO: 288 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-deoxy-2'-fluoro nucleoside
  modified_base (2)..(2): 2'-O-methyl nucleoside
  modified_base (3)..(3): 2'-deoxy-2'-fluoro nucleoside
  modified_base (4)..(4): 2'-O-methyl nucleoside
  modified_base (5)..(5): 2'-deoxy-2'-fluoro nucleoside
  modified_base (6)..(6): 2'-O-methyl nucleoside
  modified_base (7)..(7): 2'-deoxy-2'-fluoro nucleoside
  modified_base (8)..(8): 2'-O-methyl nucleoside
  modified_base (9)..(9): 2'-deoxy-2'-fluoro nucleoside
  modified_base (10)..(10): 2'-O-methyl nucleoside
  modified_base (11)..(11): 2'-deoxy-2'-fluoro nucleoside
  modified_base (12)..(12): 2'-O-methyl nucleoside
  modified_base (13)..(13): 2'-deoxy-2'-fluoro nucleoside
  modified_base (14)..(14): 2'-O-methyl nucleoside
  modified_base (15)..(15): 2'-deoxy-2'-fluoro nucleoside
  modified_base (16)..(16): 2'-O-methyl nucleoside
  modified_base (17)..(17): 2'-deoxy-2'-fluoro nucleoside
  modified_base (18)..(18): 2'-O-methyl nucleoside
  modified_base (19)..(19): 2'-deoxy-2'-fluoro nucleoside
  misc_feature (20)..(21): phosphorothioate linkage
ugcccauccuggucgagcutt

SEQ ID NO: 289 - DNA, 21 bp, Artificial Sequence
  Description of Artificial Sequence: Synthetic oligonucleotide
  Description of Combined DNA/RNA Molecule: Synthetic oligonucleotide
  5'-phosphate
  modified_base (1)..(1): 2'-O-methyl nucleoside
  modified_base (2)..(2): 2'-deoxy-2'-fluoro nucleoside
  modified_base (3)..(3): 2'-O-methyl nucleoside
  modified_base (4)..(4): 2'-deoxy-2'-fluoro nucleoside
  modified_base (5)..(5): 2'-O-methyl nucleoside
  modified_base (6)..(6): 2'-deoxy-2'-fluoro nucleoside
  modified_base (7)..(7): 2'-O-methyl nucleoside
  modified_base (8)..(8): 2'-deoxy-2'-fluoro nucleoside
  modified_base (9)..(9): 2'-O-methyl nucleoside
  modified_base (10)..(10): 2'-deoxy-2'-fluoro nucleoside
  modified_base (11)..(11): 2'-O-methyl nucleoside
  modified_base (12)..(12): 2'-deoxy-2'-fluoro nucleoside
  modified_base (13)..(13): 2'-O-methyl nucleoside
  modified_base (14)..(14): 2'-deoxy-2'-fluoro nucleoside
  modified_base (15)..(15): 2'-O-methyl nucleoside
  modified_base (16)..(16): 2'-deoxy-2'-fluoro nucleoside
  modified_base (17)..(17): 2'-O-methyl nucleoside
  modified_base (18)..(18): 2'-deoxy-2'-fluoro nucleoside
  modified_base (19)..(19): 2'-O-methyl nucleoside
  misc_feature (20)..(21): phosphorothioate linkage
agcucgaccaggaugggcatt

SEQ ID NO: 290 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-deoxy-2'-fluoro nucleoside
  modified_base (3)..(3): 2'-deoxy-2'-fluoro nucleoside
  modified_base (5)..(5): 2'-deoxy-2'-fluoro nucleoside
  modified_base (7)..(7): 2'-deoxy-2'-fluoro nucleoside
  modified_base (9)..(9): 2'-deoxy-2'-fluoro nucleoside
  modified_base (11)..(11): 2'-deoxy-2'-fluoro nucleoside
  modified_base (13)..(13): 2'-deoxy-2'-fluoro nucleoside
  modified_base (15)..(15): 2'-deoxy-2'-fluoro nucleoside
  modified_base (17)..(17): 2'-deoxy-2'-fluoro nucleoside
  modified_base (19)..(19): 2'-deoxy-2'-fluoro nucleoside
  misc_feature (20)..(21): phosphorothioate linkage
ugcccauccuggucgagcutt

SEQ ID NO: 291 - DNA, 21 bp, Artificial Sequence
  Description of Artificial Sequence: Synthetic oligonucleotide
  Description of Combined DNA/RNA Molecule: Synthetic oligonucleotide
  5'-phosphate
  modified_base (2)..(2): 2'-deoxy-2'-fluoro nucleoside
  modified_base (4)..(4): 2'-deoxy-2'-fluoro nucleoside
  modified_base (6)..(6): 2'-deoxy-2'-fluoro nucleoside
  modified_base (8)..(8): 2'-deoxy-2'-fluoro nucleoside
  modified_base (10)..(10): 2'-deoxy-2'-fluoro nucleoside
  modified_base (12)..(12): 2'-deoxy-2'-fluoro nucleoside
  modified_base (14)..(14): 2'-deoxy-2'-fluoro nucleoside
  modified_base (16)..(16): 2'-deoxy-2'-fluoro nucleoside
  modified_base (18)..(18): 2'-deoxy-2'-fluoro nucleoside
  misc_feature (20)..(21): phosphorothioate linkage
agcucgaccaggaugggcatt

SEQ ID NO: 292 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl nucleoside
  modified_base (4)..(4): 2'-O-methyl nucleoside
  modified_base (6)..(6): 2'-O-methyl nucleoside
  modified_base (8)..(8): 2'-O-methyl nucleoside
  modified_base (10)..(10): 2'-O-methyl nucleoside
  modified_base (12)..(12): 2'-O-methyl nucleoside
  modified_base (14)..(14): 2'-O-methyl nucleoside
  modified_base (16)..(16): 2'-O-methyl nucleoside
  modified_base (18)..(18): 2'-O-methyl nucleoside
  misc_feature (20)..(21): phosphorothioate linkage
ugcccauccuggucgagcutt

SEQ ID NO: 293 - DNA, 21 bp, Artificial Sequence
  Description of Artificial Sequence: Synthetic oligonucleotide
  Description of Combined DNA/RNA Molecule: Synthetic oligonucleotide
  5'-phosphate
  modified_base (1)..(1): 2'-O-methyl nucleoside
  modified_base (3)..(3): 2'-O-methyl nucleoside
  modified_base (5)..(5): 2'-O-methyl nucleoside
  modified_base (7)..(7): 2'-O-methyl nucleoside
  modified_base (9)..(9): 2'-O-methyl nucleoside
  modified_base (11)..(11): 2'-O-methyl nucleoside
  modified_base (13)..(13): 2'-O-methyl nucleoside
  modified_base (15)..(15): 2'-O-methyl nucleoside
  modified_base (17)..(17): 2'-O-methyl nucleoside
  modified_base (19)..(19): 2'-O-methyl nucleoside
  misc_feature (20)..(21): phosphorothioate linkage
agcucgaccaggaugggcatt

What is claimed is:

1. A conjugate of formula IV

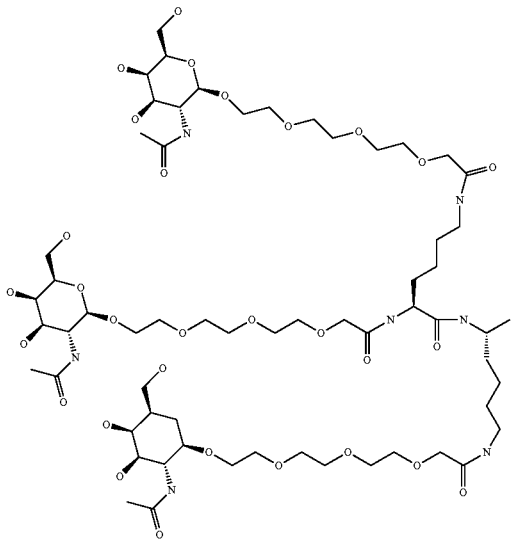
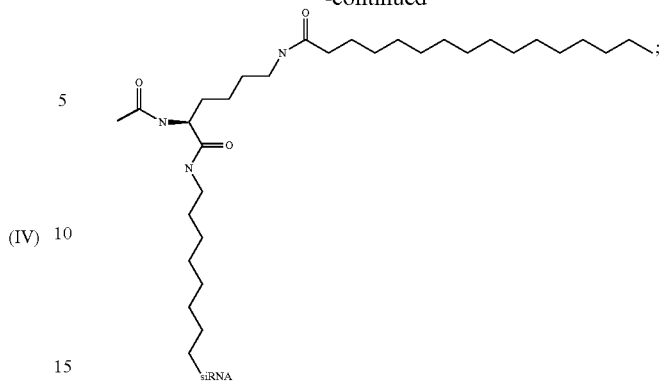

(IV)

wherein siRNA comprises
an antisense strand with the modification pattern 5'-(w)-(Z1)-(Z2)-(Z3)$n_a$-3' and
a sense strand with the modification pattern 5'-(Z3)$n_s$-3', wherein
w is independently a 5'-phosphate or 5'-phosphothioate or H,
Z1 is independently a 2'-modified nucleotide.
Z2 is independently a 2'-deoxy nucleotide or 2'-Fluoro-modified nucleotide,
Z3 is independently a 2'-modified nucleotide,
$n_a$ is 8-23 nucleotides and $n_s$ is 8-25 nucleotides.

2. A pharmaceutical composition comprising a conjugate according to claim 1.

3. The conjugate of claim 1 made by the process of reacting the siRNA with a compound of formula (III):

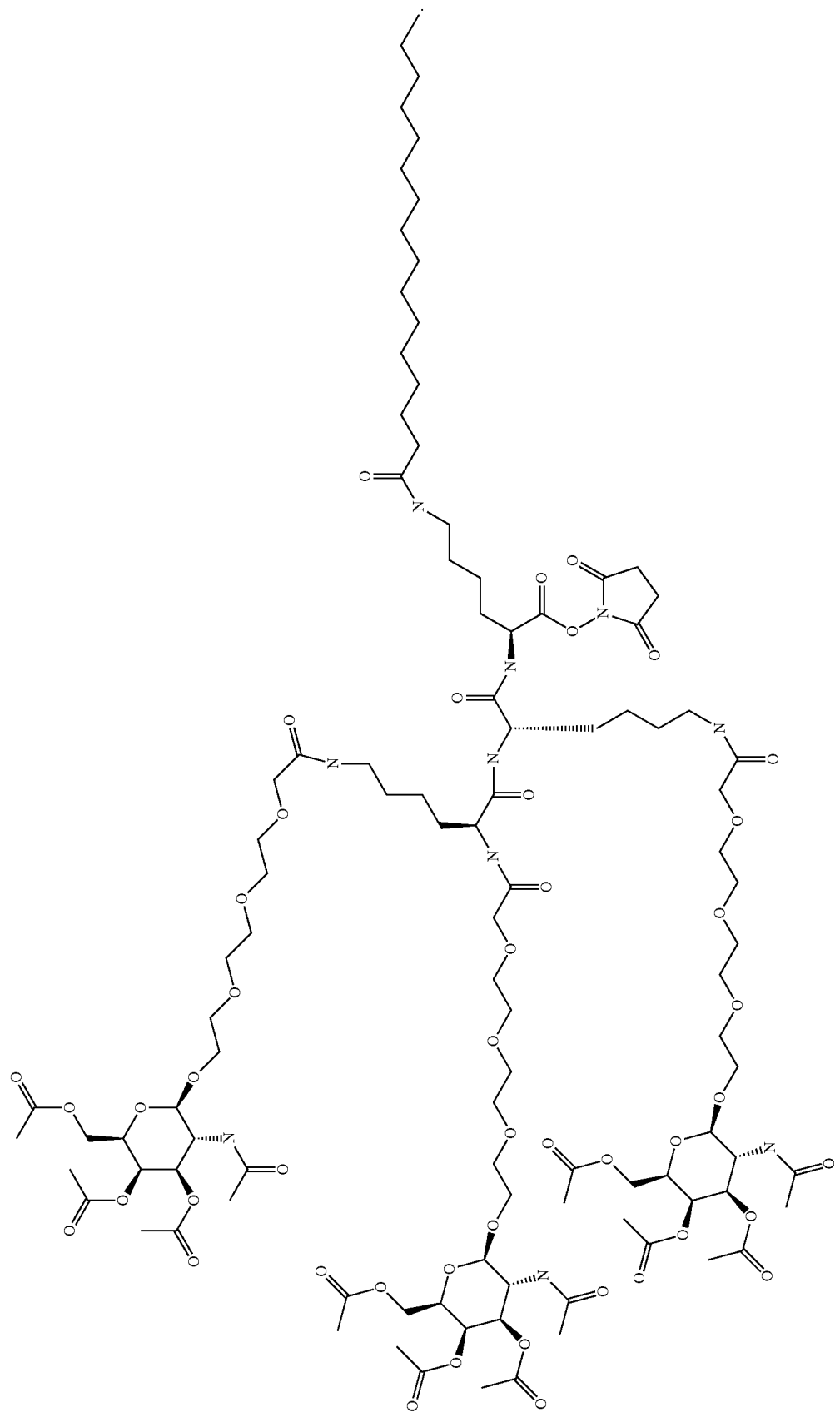

4. The conjugate of claim 1 wherein the siRNA comprises SEQ ID NOs selected from 179/166, 179/190, 179/185, 179/186, 179/190, 179/262, 179/263, and 180/168.

5. The conjugate of claim 1 wherein Z3 is selected from a 2'-O-methyl modified nucleoside, a 2'-fluoro-modified nucleoside and a 2' deoxy-nucleoside.

* * * * *